US009689040B2

(12) United States Patent
Lieberman et al.

(10) Patent No.: US 9,689,040 B2
(45) Date of Patent: Jun. 27, 2017

(54) SELECTIVE INHIBITORS OF TUMOR-INITIATING CELLS

(75) Inventors: Judy Lieberman, Brookline, MA (US); Fabio Petrocca, Boston, MA (US)

(73) Assignee: Children's Medical Center Corporation, Boston, MA (US)

( * ) Notice: Subject to any disclaimer, the term of this patent is extended or adjusted under 35 U.S.C. 154(b) by 514 days.

(21) Appl. No.: 14/003,021

(22) PCT Filed: Mar. 2, 2012

(86) PCT No.: PCT/US2012/027474
§ 371 (c)(1),
(2), (4) Date: Feb. 7, 2014

(87) PCT Pub. No.: WO2012/122015
PCT Pub. Date: Sep. 13, 2012

(65) Prior Publication Data
US 2014/0155332 A1  Jun. 5, 2014

Related U.S. Application Data

(60) Provisional application No. 61/449,353, filed on Mar. 4, 2011.

(51) Int. Cl.
| | |
|---|---|
| *C12Q 1/68* | (2006.01) |
| *G01N 33/574* | (2006.01) |
| *A61K 31/165* | (2006.01) |
| *A61K 31/167* | (2006.01) |
| *A61K 31/713* | (2006.01) |
| *A61K 38/05* | (2006.01) |

(52) U.S. Cl.
CPC .......... *C12Q 1/6886* (2013.01); *A61K 31/165* (2013.01); *A61K 31/167* (2013.01); *A61K 31/713* (2013.01); *A61K 38/05* (2013.01); *G01N 33/57415* (2013.01); *C12Q 2600/158* (2013.01); *G01N 2500/10* (2013.01); *G01N 2800/52* (2013.01); *G01N 2800/56* (2013.01)

(58) Field of Classification Search
CPC .................... C12Q 1/6886; G01N 33/57415
See application file for complete search history.

(56) References Cited

U.S. PATENT DOCUMENTS

| | | | |
|---|---|---|---|
| 7,045,292 B2 | 5/2006 | Mai et al. | |
| 7,858,317 B2 | 12/2010 | Sukumar et al. | |
| 2008/0200412 A1 | 8/2008 | Fisher | |
| 2010/0297137 A1 | 11/2010 | Caligaris-Cappio et al. | |

OTHER PUBLICATIONS

Affymetrix HG-U122 plus 2.0; [HG-U133_Plus_2] Affymetrix Human Genome U133 Plus 2.0 Array; http://www.ncbi.nlm.nih.gov/geo/query/acc.cgi?acc=GPL570; public Nov. 7, 2003; pp. 1-4.*

Al-Hajj, M., Wicha, M.S., Benito-Hernandez, A., Morrison, S.J. & Clarke, M.F. Prospective identification of tumorigenic breast cancer cells. Proc Natl Acad Sci USA 100, 3983-3988 (2003).
Awada, A., et al. Bortezomibldocetaxel combination therapy in patients with anthracycline-pretreated advanced/metastatic breast cancer: a phase I/II dose-escalation study. Br J Cancer 98, 1500-1507 (2008).
Baur, J.A. & Sinclair, D.A. Therapeutic potential of resveratrol: the in vivo evidence. Nat Rev Drug Discov 5, 493-506 (2006).
Birmingham, A., et al. Statistical methods for analysis of high-throughput RNA interference screens. Nat Methods 6, 569-575 (2009).
Carroll, J.S., et al. Genome-wide analysis of estrogen receptor binding sites. Nat Genet. 38, 1289-1297 (2006).
Chaffer, C.L. & Weinberg, R.A. Cancer cell of origin: spotlight on luminal progenitors. Cell Stem Cell 7, 271-272 (2010).
Cohen, P. & Tcherpakov, M. Will the Ubiquitin System Furnish as Many Drug Targets as Protein Kinases? Cell 143, 686-693 (2010).
Cresta, S., et al. Phase I study of bortezomib with weekly paclitaxel in patients with advanced solid tumours. Eur J Cancer 44, 1829-1834 (2008).
Croft, D., et al. Reactome: a database of reactions, pathways and biological processes. Nucleic Acids Res 39, D691-697 (2011).
Foulkes, W.D., Smith, I.E. & Reis-Filho, J.S. Triple-negative breast cancer. N Engl J Med 363, 1938-1948 (2010).
Gomez-Bougie, P., et al. Noxa up-regulation and Mcl-1 cleavage are associated to apoptosis induction by bortezomib in multiple myeloma. Cancer Res 67, 5418-5424 (2007).
Gupta, P.B., et al. Identification of Selective Inhibitors of Cancer Stem Cells by High-Throughput Screening. Cell, pp. 645-659 (2009).
Gusterson, B. Do 'basal-like' breast cancers really exist? Nat Rev Cancer 9, 128-134 (2009).
Harley, M.E., Allan, L.A., Sanderson, H.S. & Clarke, P.R. Phosphorylation of Mcl-1 by CDK1-cyclin B1 initiates its Cdc20-dependent destruction during mitotic arrest. EMBO J 29, 2407-2420 (2010).
Honeth, G., et al. The CD44+/CD24- phenotype is enriched in basal-like breast tumors. Breast Cancer Res 10, R53 (2008).
Ince, T., et al. Transformation of Different Human Breast Epithelial Cell Types Leads to Distinct Tumor Phenotypes. Cancer Cell 12, 160-170 (2007).
Irvin, W.J., et al. Phase II Study of Bortezomib and Pegylated Liposomal Doxorubicin in the Treatment of Metastatic Breast Cancer. Clin Breast Cancer 10, 465-470 (2010).
Jiang, Z., et al. Rb deletion in mouse mammary progenitors induces luminal-B or basal-like/EMT tumor subtypes depending on p53 status. J Clin Invest 120, 3296-3309 (2010).

(Continued)

*Primary Examiner* — Antonio Galisteo Gonzalez
(74) *Attorney, Agent, or Firm* — Nixon Peabody LLP

(57) ABSTRACT

Described herein are novel malignancy associated gene signature biomarkers, and assays and methods thereof, to classify prognosis or malignant potential of a cancer and identify cancer-initiating cells. The malignancy associated gene signature biomarkers, assays and methods described herein provide, in part, new methodologies to screen for novel drugs for treating cancers and tumors, such as, for example, triple-negative breast tumors. Using the assays and methods described herein proteasome inhibitors, histone deacetylase inhibitors, and glycolysis inhibitors, were identified as being highly effective in altering gene expression signatures specifically in malignant or cancer-initiating cells.

2 Claims, 45 Drawing Sheets

(56) References Cited

OTHER PUBLICATIONS

Kanehisa, M., Goto, S., Furumichi, M., Tanabe, M. & Hirakawa, M. KEGG for representation and analysis of molecular networks involving diseases and drugs. Nucleic Acids Res 38, D355-360 (2010).

Killcoyne, S., Carter, G.W., Smith, J. & Boyle, J. Cytoscape: a community-based framework for network modeling. Methods Mol Biol 563, 219-239 (2009).

Lamb, J. The Connectivity Map: a new tool for biomedical research. Nat Rev Cancer 7, 54-60 (2007).

Lamb, J., et al. The Connectivity Map: using gene-expression signatures to connect small molecules, genes, and disease. Science 313, 1929-1935 (2006).

Li, Z., et al. ETV6-NTRK3 fusion oncogene initiates breast cancer from committed mammary progenitors via activation of AP1 complex. Cancer Cell 12, 542-558 (2007).

Loboda, A., et al. A gene expression signature of RAS pathway dependence predicts response to PI3K and RAS pathway inhibitors and expands the population of RAS pathway activated tumors. BMC Med Genomics 3, 26 (2010).

Locasale, J.W., Vander Heiden, M.G. & Cantley, L.C. Rewiring of glycolysis in cancer cell metabolism. Cell Cycle 9, 4253 (2010).

Luo, J., et al. A Genome-wide RNAi Screen Identifies Multiple Synthetic Lethal Interactions with the Ras Oncogene. Cell 137, 835-848 (2009).

Manie, E., et al. High frequency of TP53 mutation in BRCA1 and sporadic basal-like carcinomas but not in BRCA1 luminal breast tumors. Cancer Res 69, 663-671 (2009).

Molyneux, G. & Smalley, M.J. The Cell of Origin of BRCA1 Mutation-associated Breast Cancer: A Cautionary Tale of Gene Expression Profiling. J Mammary Gland Biol Neoplasia, pp. 403-417 (2011).

Molyneux, G., et al. BRCA1 basal-like breast cancers originate from luminal epithelial progenitors and not from basal stem cells. Cell Stem Cell 7, 403-417 (2010).

Park, S.Y., et al. Heterogeneity for Stem Cell-Related Markers According to Tumor Subtype and Histologic Stage in Breast Cancer. Clin Cancer Res 16, 876-887 (2010).

Petrocca, F., et al. E2F1-regulated microRNAs impair TGFbeta-dependent cell-cycle arrest and apoptosis in gastric cancer. Cancer Cell 13, 272-286 (2008).

Pico, A.R., et al. WikiPathways: pathway editing for the people. PLoS Biol 6, e184 (2008).

Prat, A., et al. Phenotypic and molecular characterization of the claudin-low intrinsic subtype of breast cancer. Breast Cancer Res 12, R68 (2010).

Quintana, E., et al. Efficient tumour formation by single human melanoma cells. Nature 456, 593-598 (2008).

Rakha, E.A. & Ellis, I.O. Triple-negative/basal-like breast cancer: review. Pathology 41, 40-47 (2009).

Richardson, A.L., et al. X chromosomal abnormalities in basal-like human breast cancer. Cancer Cell 9, 121-132 (2006).

Trere, D., et al. High prevalence of retinoblastoma protein loss in triple-negative breast cancers and its association with a good prognosis in patients treated with adjuvant chemotherapy. Ann Oncol 20, 1818-1823 (2009).

van de Vijver, M.J., et al. A gene-expression signature as a predictor of survival in breast cancer. N Engl J Med. 347, 1999-2009 (2002).

Verhaak, R.G., et al. Prediction of molecular subtypes in acute myeloid leukemia based on gene expression profiling. Haematologica 94, 131-134 (2009).

Visvader, J.E. Cells of origin in cancer. Nature 469, 314-322 (2011).

Wang, Y., et al. Gene-expression profiles to predict distant metastasis of lymph-node-negative primary breast cancer. Lancet 365, 671-679 (2005).

Warde-Farley, D., et al. The GeneMANIA prediction server: biological network integration for gene prioritization and predicting gene function. Nucleic Acids Res 38, W214-220 (2010).

Yu, F., et al. let-7 regulates self renewal and tumorigenicity of breast cancer cells. Cell 131, 1109-1123 (2007).

Zhang, J.H. Chung, T.D. & Oldenburg, K.R. A Simple Statistical Parameter for Use in Evaluation and Validation of High Throughput Screening Assays. J Biomol Screen 4, 67-73 (1999).

* cited by examiner

| TUMORS FORMED | | | |
|---|---|---|---|
| CELLS | BPLER | HMLER | MCF7 |
| 5x10⁴ | 4/4 | 0/4 | 0/4 |
| 5x10³ | 4/4 | 0/4 | 0/4 |
| 5x10² | 4/4 | 0/4 | 0/4 |
| 5x10 | 4/4 | 0/4 | 0/4 |

| SCREENING HITS | | | | |
|---|---|---|---|---|
| | RATIO (R) | HITS | CONFIRMED HITS | VALIDATION RATE |
| HIGHLY SELECTIVE | R≤0.55 | 26 | 23 | 88% |
| MODERATELY SELECTIVE | 0.55<R≤0.65 | 76 | 57 | 75% |
| MODESTLY SELECTIVE | 0.65<R≤0.75 | 143 | 74 | 52% |
| TOTAL | | 245 | 154 | 63% |

| HIGHLY SELECTIVE BPLER INHIBITORS | | | |
|---|---|---|---|
| | Z SCORE | RATIO | siRNAs SCORING + |
| PSMB4 | -6.73 | 0.28 | 4 |
| RAN | -5.67 | 0.47 | 2 |
| PSMA1 | -5.53 | 0.37 | 4 |
| SNW1 | -5.45 | 0.45 | 3 |
| PRPF8 | -5.34 | 0.40 | 2 |
| DDX19B | -4.84 | 0.46 | 3 |
| ZNF490 | -4.40 | 0.49 | 1 |
| DHX8 | -4.27 | 0.51 | 4 |
| PSMA2 | -4.14 | 0.38 | 2 |
| UBL5 | -4.14 | 0.53 | 2 |
| PSMD7 | -3.88 | 0.49 | 2 |
| DHRS13 | -3.66 | 0.47 | 1 |
| RACGAP1 | -3.61 | 0.47 | 4 |
| ZNF574 | -3.52 | 0.54 | 1 |
| ZNF643 | -3.05 | 0.54 | 1 |
| FIZ1 | -2.97 | 0.55 | 1 |
| RFT1 | -2.82 | 0.47 | 1 |
| PPP2CA | -2.77 | 0.53 | 2 |
| HAUS3 | -2.52 | 0.52 | 3 |
| ETHE1 | -2.19 | 0.55 | 1 |
| PSMC3 | -1.77 | 0.49 | 4 |
| PSMA3 | -1.72 | 0.48 | 4 |
| PSMC1 | -1.50 | 0.52 | 2 |

*FIG. 2C*

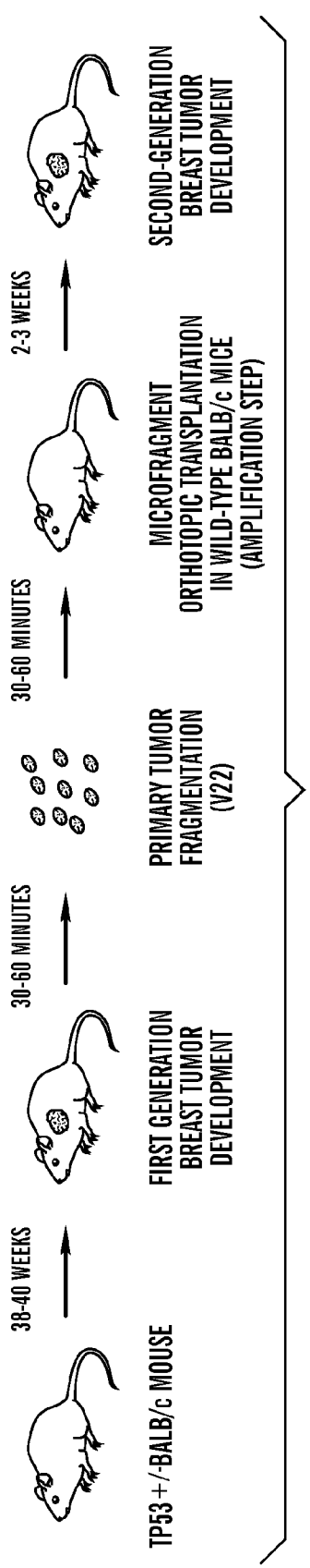
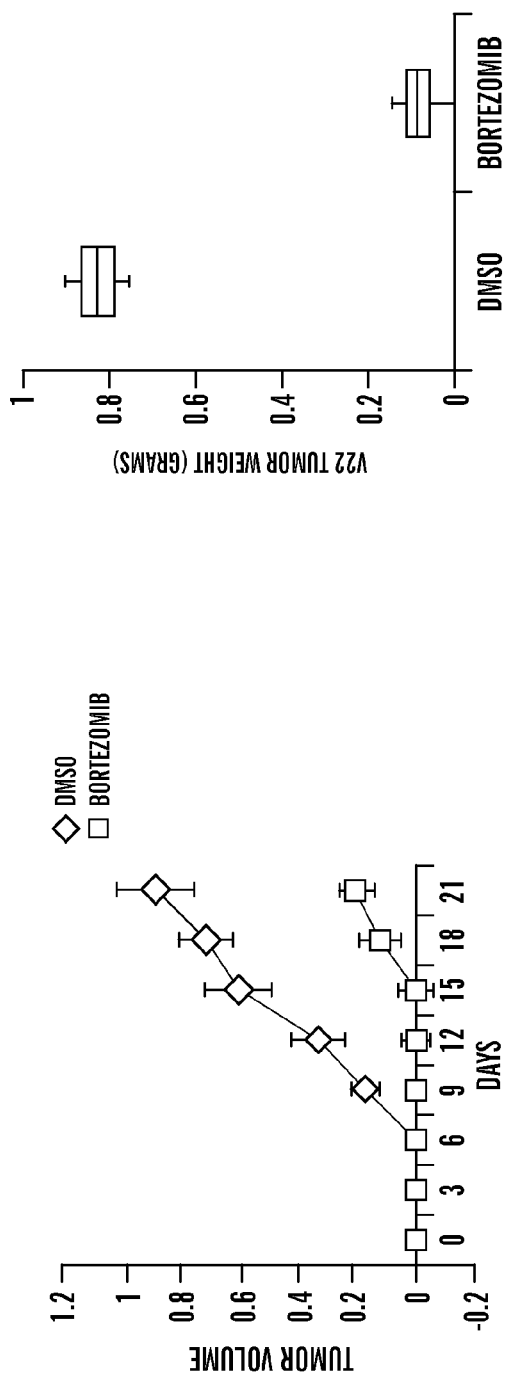
FIG. 6H
FIG. 6I
FIG. 6J

US 9,689,040 B2

SELECTIVE INHIBITORS OF TUMOR-INITIATING CELLS

CROSS-REFERENCE TO RELATED APPLICATIONS

This application is a 35 U.S.C. §371 National Phase Entry Application of International Application No. PCT/US2012/027474 filed Mar. 2, 2012, which designates the U.S., and which claims benefit under 35 U.S.C. §119(e) of U.S. Provisional Patent Application Ser. No. 61/449,353 filed on Mar. 4, 2011, the contents of each of which are incorporated herein by reference in their entireties.

GOVERNMENT SUPPORT

This invention was made with Government support under W81XWH-09-1-0670 awarded by the Department of Defense. The Government has certain rights in the invention.

SEQUENCE LISTING

The instant application contains a Sequence Listing which has been submitted in ASCII format via EFS-Web and is hereby incorporated by reference in its entirety. Said ASCII copy, created on Sep. 4, 2013, is named 033393-069632 SequenceListing.txt and is 776,090 bytes in size.

FIELD OF THE INVENTION

The present invention relates to novel malignancy associated response signatures associated with tumors, such as basal-like breast tumors, and methods and assays of diagnosis, prognosis, and treatment thereof.

BACKGROUND

Despite basic and clinical research directed at understanding and controlling breast cancer, breast cancer is still a major health threat worldwide. Basal-like breast tumors (BL-BTs) or triple-negative breast cancers (TNBCs) are an especially aggressive group of tumors often found in young Afro-American and Hispanic women, with the shortest survival of all breast cancer subtypes, including luminal A, luminal B, HER2, normal-like, and claudin-low tumors. These tumors comprise ~15% of human breast cancers, and more than 75% of breast cancers arising in women carrying a BRCA1 mutation.

TNBCs are estrogen receptor, progesterone receptor and HER2 negative (triple-negative), and can express different combinations of CK5, CK14, CK17, CK18 and/or EGFR. These tumors retain a mixed luminal/myoepithelial (i.e., progenitor-like) phenotype, and recent studies indicate that TNBCs derive from transformed mammary epithelial progenitors. Concomitant genetic ablation of RB and TP53, or BRCA1 alone, in the progenitor cell compartment of the mouse mammary gland induces the development of basal-like malignant tumors. Notably, mutations in TP53 and/or RB genes occur in over 90% of human BL-BTs.

BL-BTs have distinct morphological and cytological features. They are typically poorly differentiated lesions with high mitotic counts, central areas of necrosis, pushing borders and prominent stromal lymphocytic infiltrates. Basal-like cancer cells, which can be arranged in solid sheets or nests, are atypical and pleomorphic, and are highly enriched for cells with the CD44+/CD24$^{low/-}$ phenotype, which has been associated with tumor-initiating potential.

Despite response to front-line chemotherapy, tumors such as BL-BTs have a grim prognosis because of early relapse within the first five years of diagnosis. BL-BTs rapidly acquire resistance to chemotherapy and are refractory to endocrine therapy and HER-2 inhibitors. Therefore there is a need for identifying methods to diagnose and treat refractory tumors, such as basal-like breast tumors.

SUMMARY OF THE INVENTION

The invention provides novel malignancy associated response signatures and assays and methods thereof to classify and diagnose tumors, such as basal-like breast tumors and other poor prognosis tumors, using a newly identified gene expression signature identified in basal-like breast tumor cells. Moreover, the invention provides new methods to screen for novel drugs for treating cancers and tumors, such as basal-like breast tumors, using, for example, proteasome inhibitors, histone deacetylase inhibitors, glycolysis inhibitors, or a combination thereof, which were identified as being effective in altering the gene expression signature of malignant cells. The invention is based, at least in part, on findings of a genome-wide siRNA lethality screen in highly malignant progenitor-like breast epithelial cells, which recapitulate several basal-like features and give rise to tumors closely resembling human primary BL-BTs. As shown herein, we identified core survival pathways and a "malignancy associated response signature" that are selectively associated with tumor-initiating potential that are useful for prognostic and diagnostic applications and reveal novel therapeutic targets for more effective and enhanced treatment of poor prognosis tumors, such as BL-BTs.

Accordingly, in some aspects, provided herein are, malignancy associated response signatures for a cancer-initiating cell consisting essentially of an expression pattern of a set of biomarkers set forth in SEQ ID NOs: 1-4, 6, 7, 13, 14, 23, 29, 33-35, 37, 38, 66, 72, 77, 78, 84, 91, 93, and 151, where at least 5 of the 23 biomarkers have increased expression compared to a reference value.

In some embodiments of these aspects and all such aspects described herein, the cancer-initiating cell is a breast cancer-initiating cell.

In some embodiments of these aspects and all such aspects described herein, the cancer-initiating cell is a triple-negative breast cancer-initiating cell.

In some embodiments of these aspects and all such aspects described herein, the cancer-initiating cell is a Luminal B breast cancer-initiating cell In some embodiments of these aspects and all such aspects described herein, the cancer-initiating cell is an epithelial breast cancer-initiating cell.

In some embodiments of these aspects and all such aspects described herein, the expression of the at least 5 of the 23 biomarkers is increased at least 1.8-fold compared to the reference value.

Also provided herein, in some aspects, are malignancy associated response signatures for a cancer-initiating cell comprising an expression pattern of a set of at least 10 biomarkers set forth in SEQ ID NOs: 1-154, where at least 10 of the 154 markers have increased expression compared to a reference value.

In some embodiments of these aspects and all such aspects described herein, the cancer-initiating cell is a breast cancer-initiating cell.

In some embodiments of these aspects and all such aspects described herein, the cancer-initiating cell is a triple-negative breast cancer-initiating cell.

In some embodiments of these aspects and all such aspects described herein, the cancer-initiating cell is a Luminal B breast cancer-initiating cell.

In some embodiments of these aspects and all such aspects described herein, the cancer-initiating cell is an epithelial breast cancer-initiating cell.

In some embodiments of these aspects and all such aspects described herein, the expression of the at least 5 biomarkers is increased at least 1.8-fold compared to the reference value.

In some embodiments of these aspects and all such aspects described herein, at least 2 of the set of at least 10 biomarkers set forth in SEQ ID NOs: 1-154 is selected from the group consisting of SEQ ID NOs: 1-4, 6, 7, 13, 14, 23, 29, 33-35, 37, 38, 66, 72, 77, 78, 84, 91, 93, and 151.

In some aspects, provided herein are malignancy associated response signatures for a cancer-initiating cell susceptible to proteasomal gene inhibition comprising an expression pattern of a set of at least 3 biomarkers set forth in SEQ ID NOs: 1, 2, 4, 7, 15, 16, 21, 29, 33, 34, 38, 60, 74, 76, and 149, such that at least 3 of the 15 biomarkers have increased expression compared to a reference value.

In some aspects, provided herein are malignancy associated response signatures for a cancer-initiating cell susceptible to mitosis gene inhibition comprising an expression pattern of a set of at least 3 biomarkers set forth in SEQ ID NOs: 9, 17, 22, 23, 31, 37, 35, 52, 68, 80, 101, 124, 130, and 137, where at least 3 of the 14 biomarkers have increased expression compared to a reference value.

In some aspects, provided herein are malignancy associated response signatures for a cancer-initiating cell susceptible to RNA splicing gene inhibition comprising an expression pattern of a set of at least 3 biomarkers set forth in SEQ ID NOs: 5, 10, 11, 18, 20, 26, 36, 41, 57, 61, 123, 127, and 151, where at least 3 of the 13 biomarkers have increased expression compared to a reference value.

In some aspects, provided herein are malignancy associated response signatures for a cancer-initiating cell susceptible to molecular transport gene inhibition comprising an expression pattern of a set of at least 3 biomarkers set forth in SEQ ID NOs: 12, 13, 32, 48, 51, 56, 64, 91, 96, 98, 108, 121, and 147, where at least 3 of the 14 biomarkers have increased expression compared to a reference value.

In some aspects, provided herein are malignancy associated response signatures for a cancer-initiating cell susceptible to metabolic gene inhibition comprising an expression pattern of a set of at least 3 biomarkers of SEQ ID NOs: 46, 49, 65, 69, 72, 78, 104, 107, 112, 126, 138, 141, and 153, where at least 3 of the 13 biomarkers have increased expression compared to a reference value.

In some embodiments of these aspects and all such aspects described herein, the cancer-initiating cell is a breast cancer-initiating cell.

In some embodiments of these aspects and all such aspects described herein, the cancer-initiating cell is a triple-negative breast cancer-initiating cell.

In some embodiments of these aspects and all such aspects described herein, the cancer-initiating cell is a Luminal B breast cancer-initiating cell.

In some embodiments of these aspects and all such aspects described herein, the cancer-initiating cell is an epithelial breast cancer-initiating cell.

In some embodiments of these aspects and all such aspects described herein, the expression of the at least 3 biomarkers is at least 1.8-fold increased compared to the reference value.

In other aspects, provided herein are methods of classifying a cancer in a subject in need thereof, the method comprising: a) assaying expression of ten or more of the 154 malignancy associated response signature biomarkers of SEQ ID NOs: 1-154 in a biological sample obtained from the subject having a cancer, and b) comparing the expression of the ten or more of the 154 malignancy associated response signature biomarkers of SEQ ID NOs: 1-154 in the biological sample obtained from the subject having a cancer with a reference value, where increased expression of 1.8-fold or greater of at least ten of the biomarkers in the biological sample obtained from the subject relative to the reference value indicates that the cancer is classified as having a poor prognosis or being a malignant cancer, and absence of increased expression of 1.8-fold or greater of at least ten of the biomarkers relative to the reference value indicates that the cancer does not have poor prognosis or is not a malignant cancer.

In some embodiments of these methods and all such methods described herein, the cancer is a breast cancer.

In some embodiments of these methods and all such methods described herein, the cancer is a triple-negative breast cancer.

In some embodiments of these methods and all such methods described herein, the cancer is a Luminal B breast cancer.

In some embodiments of these methods and all such methods described herein, the cancer is an epithelial breast cancer.

In some embodiments of these methods and all such methods described herein, if the cancer is classified as having a poor prognosis or being a malignant cancer, the method further comprises the step of administering at least one proteasome inhibitor to the subject.

In some embodiments of these methods and all such methods described herein, if the cancer is classified as having a poor prognosis or being a malignant cancer and if at least two of the ten or more genes having increased expression is a proteasomal malignancy associated response signature biomarker of SEQ ID NOs: 1, 2, 4, 7, 15, 16, 21, 29, 33, 34, 38, 60, 74, 76, and 149, the method further comprises the step of administering at least one proteasome inhibitor to the subject.

In some embodiments of these methods and all such methods described herein, the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.

In some embodiments of these methods and all such methods described herein, the at least one proteasome inhibitor specifically inhibits the malignancy associated response signature biomarker set forth in SEQ ID NOs: 134 (MCL-1).

In some embodiments of these methods and all such methods described herein, the at least one proteasome inhibitor is an siRNA or antisense RNA agent.

In some embodiments of these methods and all such methods described herein, the at least one proteasome inhibitor is bortezomib.

In some embodiments of these methods and all such methods described herein, if the cancer is classified as having a poor prognosis or being a malignant cancer, the method further comprises the step of administering at least one histone deacetylase inhibitor to the subject.

In some embodiments of these methods and all such methods described herein, the at least one histone deacetylase inhibitor is an siRNA or antisense RNA agent.

In some embodiments of these methods and all such methods described herein, the at least one histone deacetylase inhibitor is trichostatin A (TSA) or Vorinostat.

In some embodiments of these methods and all such methods described herein, if the cancer is classified as having a poor prognosis or being a malignant cancer, the method further comprises the step of administering at least one glygolytic inhibitor to the subject. In some such embodiments, the at least one glycolysis inhibitor is an siRNA or antisense RNA agent.

In some embodiments of these methods and all such methods described herein, if the cancer is classified as having a poor prognosis or being a malignant cancer, relative survival rate, relative risk of metastasis, treatment option, or any combination thereof is determined for the subject.

In some aspects, provided herein are methods of classifying a cancer in a subject in need thereof, the method comprising: a) assaying expression of at least five biomarkers set forth in SEQ ID NOs: 1-4, 6, 7, 13, 14, 23, 29, 33-35, 37, 38, 66, 72, 77, 78, 84, 91, 93, and 151 in a biological sample obtained from the subject having a cancer, and b) comparing the expression of the five or more of the 23 malignancy associated response signature biomarkers in the biological sample obtained from the subject having a cancer with a reference value, where increased expression of 1.8-fold or greater of at least ten of the biomarkers in the biological sample obtained from the subject relative to the reference value indicates that the cancer is classified as having a poor prognosis or being a malignant cancer, and absence of increased expression of 1.8-fold or greater of at least ten of the biomarkers relative to the reference value indicates that the cancer does not have poor prognosis or is not a malignant cancer.

In some embodiments of these methods and all such methods described herein, the cancer is a breast cancer.

In some embodiments of these methods and all such methods described herein, the cancer is a triple-negative breast cancer.

In some embodiments of these methods and all such methods described herein, the cancer is a Luminal B breast cancer.

In some embodiments of these methods and all such methods described herein, the cancer is an epithelial breast cancer.

In some embodiments of these methods and all such methods described herein, if the cancer is classified as having a poor prognosis or being a malignant cancer, the method further comprises the step of administering at least one proteasome inhibitor to the subject.

In some embodiments of these methods and all such methods described herein, if the cancer is classified as having a poor prognosis or being a malignant cancer and if at least one of the five or more genes having increased expression is a proteasomal malignancy associated response signature biomarker of SEQ ID NOs: 1, 2, 4, 7, 29, 33, 34, and 38, the method further comprises the step of administering at least one proteasome inhibitor to the subject.

In some embodiments of these methods and all such methods described herein, the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.

In some embodiments of these methods and all such methods described herein, the at least one proteasome inhibitor specifically inhibits the malignancy associated response signature biomarker set forth in SEQ ID NOs: 134 (MCL-1).

In some embodiments of these methods and all such methods described herein, the at least one proteasome inhibitor is an siRNA or antisense RNA agent.

In some embodiments of these methods and all such methods described herein, the at least one proteasome inhibitor is bortezomib.

In some aspects, provided herein are methods of classifying a cancer in a subject in need thereof, the method comprising: a) assaying expression of at least three malignancy associated response signature biomarkers set forth in SEQ ID NOs: 1, 2, 4, 7, 15, 16, 21, 29, 33, 34, 38, 60, 74, 76, and 149 in a biological sample obtained from the subject having a cancer, and b) comparing the expression of the at least three malignancy associated response signature biomarkers in the biological sample obtained from the subject having a cancer with a reference value, where increased expression of 1.8-fold or greater of at least three of the biomarkers in the biological sample obtained from the subject relative to the reference value indicates that the cancer is classified as having a poor prognosis or being a malignant cancer, and absence of increased expression of 1.8-fold or greater of at least three of the biomarkers relative to the reference value indicates that the cancer does not have poor prognosis or is not a malignant cancer.

In some embodiments of these methods and all such methods described herein, the cancer is a breast cancer.

In some embodiments of these methods and all such methods described herein, the cancer is a triple-negative breast cancer.

In some embodiments of these methods and all such methods described herein, the cancer is a Luminal B breast cancer.

In some embodiments of these methods and all such methods described herein, the cancer is an epithelial breast cancer.

In some embodiments of these methods and all such methods described herein, if the cancer is classified as having a poor prognosis or being a malignant cancer, the method further comprises the step of administering at least one proteasome inhibitor to the subject.

In some embodiments of these methods and all such methods described herein, the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.

In some embodiments of these methods and all such methods described herein, the at least one proteasome inhibitor specifically inhibits the malignancy associated response signature biomarker set forth in SEQ ID NOs: 134 (MCL-1).

In some embodiments of these methods and all such methods described herein, the at least one proteasome inhibitor is an siRNA or antisense RNA agent.

In some embodiments of these methods and all such methods described herein, the at least one proteasome inhibitor is bortezomib.

Also provided herein in some aspects, are assays comprising the steps of: a) measuring expression of ten or more of the 154 malignancy associated response signature biomarkers set forth in SEQ ID NOs: 1-154 in a biological sample obtained from a subject having cancer, and b) comparing the expression of the ten or more of the 154 malignancy associated response signature biomarkers set forth in SEQ ID NOs: 1-154 in the biological sample obtained from the subject having a cancer with a reference value, where increased expression of at least ten of the measured biomarkers in the biological sample obtained from the subject relative to the reference value diagnoses the patient as having a poor prognosis or malignant cancer, and absence of increased expression of at least ten of the measured biomarkers relative to the reference value diagnoses the patient as not having a poor prognosis or malignant cancer.

In some embodiments of these assays and all such assays described herein, the increased expression of the ten or more of the 154 malignancy associated response signature biomarkers in the biological sample determines a prognosis for the subject having the cancer.

In some embodiments of these assays and all such assays described herein, the prognosis comprises relative survival rate, relative risk of metastasis, treatment option, or any combination thereof.

In some embodiments of these assays and all such assays described herein, the cancer is a breast cancer.

In some embodiments of these assays and all such assays described herein, the cancer is a triple-negative breast cancer.

In some embodiments of these assays and all such assays described herein, the cancer is a Luminal B breast cancer.

In some embodiments of these assays and all such assays described herein, the cancer is an epithelial breast cancer.

In some embodiments, if the subject is diagnosed as having a poor prognosis or malignant cancer, the subject is administered at least one proteasome inhibitor.

In some embodiments of these assays and all such assays described herein, if the subject is diagnosed as having a poor prognosis or malignant cancer and if at least two of the ten or more genes having increased expression is a proteasomal malignancy associated response signature biomarker of SEQ ID NOs: 1, 2, 4, 7, 15, 16, 21, 29, 33, 34, 38, 60, 74, 76, and 149, the subject is administered at least one proteasome inhibitor.

In some embodiments of these assays and all such assays described herein, the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.

In some embodiments of these assays and all such assays described herein, the at least one proteasome inhibitor specifically inhibits the malignancy associated response signature biomarker set forth in SEQ ID NOs: 134 (MCL-1).

In some embodiments of these assays and all such assays described herein, the at least one proteasome inhibitor is an siRNA or antisense RNA agent.

In some embodiments of these assays and all such assays described herein, the at least one proteasome inhibitor is bortezomib.

In some embodiments of these assays and all such assays described herein, if the subject is diagnosed as having a poor prognosis or malignant cancer, the subject is administered at least one histone deacetylase inhibitor.

In some embodiments of these assays and all such assays described herein, the at least one histone deacetylase inhibitor is an siRNA or antisense RNA agent.

In some embodiments of these assays and all such assays described herein, the at least one histone deacetylase inhibitor is trichostatin A (TSA) or Vorinostat.

In some embodiments of these assays and all such assays described herein, if the subject is diagnosed as having a poor prognosis or malignant cancer, the subject is administered at least one glygolytic inhibitor.

In some embodiments of these assays and all such assays described herein, the at least one glycolysis inhibitor is an siRNA or antisense RNA agent.

Provided herein, in other aspects are assays comprising the steps of: (a) dividing a cell culture grown from a biopsy obtained from a subject having cancer into at least 5 separate cultures; (b) exposing each of the at least 5 separate cultures to a different inhibitory agent, wherein each of the different inhibitory agents specifically inhibits a different malignancy associated response signature biomarker set forth in SEQ ID NOs: 1-154; (c) growing each of the at least 5 separate cell cultures of step (b) for at least 12 hours; and (d) measuring viability of the cells from each of the cultures of step (c), where if the total viability of the cells in at least 60% of the cultures is decreased by at least 25%, then the biopsy obtained from the subject comprises cancer-initiating cells.

In some embodiments of these assays and all such assays described herein, the inhibitory agents are selected from siRNA agents, antisense RNA agents, or small molecules, that specifically inhibit any of the cancer gene signature biomarkers set forth in SEQ ID NOs: 1-154.

In some embodiments of these assays and all such assays described herein, the inhibitory agents specifically inhibit any of the malignancy associated response signature biomarkers set forth in SEQ ID NOs: 1-4, 6, 7, 13, 14, 23, 29, 33-35, 37, 38, 66, 72, 77, 78, 84, 91, 93, and 151.

In some embodiments of these assays and all such assays described herein, at least one inhibitory agent specifically inhibits any of the malignancy associated response signature biomarkers set forth in SEQ ID NOs: 1-4, 6, 7, 13, 14, 23, 29, 33-35, 37, 38, 66, 72, 77, 78, 84, 91, 93, and 151.

In some embodiments of these assays and all such assays described herein, at least one inhibitory agent specifically inhibits any of the proteasomal malignancy associated response signature biomarkers set forth in SEQ ID NOs: 1, 2, 4, 7, 15, 16, 21, 29, 33, 34, 38, 60, 74, 76, and 149.

In some embodiments of these assays and all such assays described herein, at least one inhibitory agent specifically inhibits any of the mitosis cancer gene signature biomarkers set forth in SEQ ID NOs: 9, 17, 22, 23, 31, 37, 35, 52, 68, 80, 101, 124, 130, and 137.

In some embodiments of these assays and all such assays described herein, at least one inhibitory agent specifically inhibits any of the RNA splicing malignancy associated response signature biomarkers set forth in SEQ ID NOs: 5, 10, 11, 18, 20, 26, 36, 41, 57, 61, 123, 127, and 151.

In some embodiments of these assays and all such assays described herein, at least one inhibitory agent specifically inhibits any of the molecular transport malignancy associated response signature biomarkers set forth in SEQ ID NOs: 12, 13, 32, 48, 51, 56, 64, 91, 96, 98, 108, 121, and 147.

In some embodiments of these assays and all such assays described herein, at least one inhibitory agent specifically inhibits any of the metabolic malignancy associated response signature biomarkers set forth in SEQ ID NOs: 46, 49, 65, 69, 72, 78, 104, 107, 112, 126, 138, 141, and 153.

Also provided herein, in some aspects, are methods for treating a cancer in a subject in need thereof comprising the step of administering to a subject having a cancer classified or diagnosed as having poor prognosis or being malignant using any of the methods or assays described herein, at least one proteasome inhibitor in a pharmaceutically acceptable carrier.

In some embodiments of these methods and all such methods described herein, the at least one proteasome inhibitor is an siRNA or antisense RNA agent.

In some embodiments of these methods and all such methods described herein, the proteasome inhibitor specifically inhibits a proteasomal malignancy associated response signature biomarkers set forth in SEQ ID NOs: 1, 2, 4, 7, 15, 16, 21, 29, 33, 34, 38, 60, 74, 76, and 149.

In some embodiments of these methods and all such methods described herein, the at least one proteasome inhibitor specifically inhibits the malignancy associated response signature biomarker set forth in SEQ ID NOs: 134 (MCL-1).

In some embodiments of these methods and all such methods described herein, the proteasome inhibitor is bortezomib.

Provided herein, in some aspects, are methods for treating a cancer in a subject in need thereof comprising the step of administering to a subject having a cancer classified or diagnosed as having poor prognosis or being malignant, using any of the methods or assays described herein, at least one histone deacetylase inhibitor in a pharmaceutically acceptable carrier.

In some embodiments of these methods and all such methods described herein, the at least one histone deacetylase inhibitor is an siRNA or antisense RNA agent.

In some embodiments of these methods and all such methods described herein, the at least one histone deacetylase inhibitor is trichostatin A (TSA) or Vorinostat.

Provided herein, in some aspects, are method for treating a cancer in a subject in need thereof comprising the step of administering to a subject having a cancer classified or diagnosed as having poor prognosis or being malignant, using any of the methods or assays described herein, at least one metabolic inhibitor in a pharmaceutically acceptable carrier.

In some embodiments of these methods and all such methods described herein, the at least one metabolic inhibitor is an siRNA or antisense RNA agent.

In some embodiments of these methods and all such methods described herein, the at least one metabolic inhibitor specifically inhibits a metabolic malignancy associated response signature biomarker set forth in SEQ ID NOs: 46, 49, 65, 69, 72, 78, 104, 107, 112, 126, 138, 141, and 153.

Also provided herein, in some aspects, are systems for obtaining data from at least one sample from a subject having a cancer, the systems comprising:

a determination module configured to receive the at least one sample from a subject having a cancer and perform an expression analysis of ten or more malignancy associated response signature biomarkers set forth in SEQ ID NOs: 1-154 on the at least one sample to generate an expression data output;

a storage device configured to store the expression data output from the determination module;

a comparison module configured to receive the expression data output of the sample from the subject having a cancer and perform at least one expression analysis on the expression data output to determine the presence or absence of one of the following conditions and produce a comparison data output where:

(i) the sample from the subject having a cancer has increased expression of ten or more metabolic malignancy associated response signature biomarkers set forth in SEQ ID NOs: 1-154; or (ii) the sample from the subject having a cancer does not have increased expression of ten or more metabolic malignancy associated response signature biomarkers set forth in SEQ ID NOs: 1-154; and an output or display module for displaying a content based in part on the comparison data output from the comparison module, where the content comprises a signal indicative that the sample from the subject having a cancer has increased expression of ten or more metabolic malignancy associated response signature biomarkers set forth in SEQ ID NOs: 1-154, or a signal indicative that the sample from the subject having a cancer does not have increased expression of ten or more metabolic malignancy associated response signature biomarkers set forth in SEQ ID NOs: 1-154.

In some embodiments of these systems and all such systems described herein, the content displayed on the display module further comprises a signal indicative of the subject being recommended to receive a particular treatment regimen.

In some aspects, provided herein are methods of identifying a candidate therapeutic agent against a cancer initiating cell comprising the steps of: a) exposing a BPLER cell culture to a test agent, where the BPLER cell culture comprises human breast primary epithelial cells (BPE) transformed with a defined set of genetic elements; b) measuring expression of at least ten of the 154 malignancy associated response signature biomarkers of SEQ ID NOs: 1-154 in the culture, c) comparing the expression of the same at least 10 biomarkers of malignancy associated response signature biomarkers of SEQ ID NOs: 1-154 as was measured in step (b) to an expression signature reference from a BPLER cell culture that has not been exposed to the test agent, wherein a decrease of expression of at least 5 of the at least 10 genes in the test culture compared to the expression signature reference indicates that the test agent is a candidate therapeutic agent against a cancer initiating cell.

Also provided herein are therapeutic agents identified by the methods of identifying a candidate therapeutic agent against a cancer initiating cell, where the agent is an siRNA agent, an antisense RNA agent, an antibody or antigen-binding fragment thereof, or a small molecule compound.

In other aspects, provided herein are pharmaceutical compounds comprising a therapeutic agent identified using any of the screening methods described herein and a pharmaceutically acceptable carrier.

BRIEF DESCRIPTION OF THE DRAWINGS

FIGS. 2A-2G demonstrate identification of genes selectively required for survival of BPLER cells. (2A) Distribution of R value and BPLER Z score for all 17,378 genes in the siRNA primary screen library. R, ratio of viability of BPLER vs HMLER. BPLER Z score, a measure of the deviation of BPLER viability from the plate mean. A Z score outside of the range of −1 to +1 is significant. Genes were considered hits if R<0.75 and the BPLER Z score was <−1.5. Shading indicates the relative selectivity of BPLER vs HMLER lethality. (2B) Validation rates in the secondary siRNA screen for which at least one individual siRNA from the library pool scored positive. (2C) List of confirmed highly selective BPLER dependency genes or malignancy associated response signature genes. (2D) Single sample gene set enrichment analysis (GSEA) of the or malignancy associated response signature and highly selective hit list in 295 human breast primary cancers in the NKI dataset. A Z-score for the expression of the signature genes was calculated for each sample. The scores are shown as beanplots to compare the distributions in the tumor subtypes (Basal, basal-like; Lum, luminal; NL, normal-like). Each bean consists of a line for each sample with the overall distribution for the subtype represented as a gray density shape and a black line indicating the median Z score. The basal-like and luminal B tumors as a group had significantly enhanced expression of TGS genes or the highly selective genes. (2E-2G) Patients were divided into two groups based on their tumor's GSEA enrichment score. The high malignancy associated response signature tumors were defined by enrichment scores with p-value <0.1, and the remaining tumors were classified as low. (2E) Kaplan-Meier survival curves for breast cancer patients in the NKI dataset, showing shorter survival of patients with higher tumor expression of all malignancy associated response signature genes (left) or the highly selective subset (right). (2F) Kaplan-Meier survival curve for luminal B breast cancer patients in the NKI dataset showing shorter survival of patients with higher tumor expression of all malignancy associated response signature genes (left) or the highly selective subset (right). (2G) Kaplan-Meier curve depicting metastasis-free survival for breast cancer patients in the NKI dataset, showing longer metastasis-free survival in patients with lower tumor expression of all malignancy associated response signature genes (left) or the highly selective subset (right).

FIGS. 6A-6J demonstrate proteasome inhibition suppresses TNBC growth in vivo. (6A) Proteasome activity in protein lysates from BPLER tumors 18 hours after intratumoral (i.t.), intraperitoneal (i.p) or intravenous (i.v.) treatment with bortezomib at the indicated dose, as determined by ProteasomeGlo assay. Proteasome activity in BPLER treated with bortezomib in vitro is shown as control. (6B-6E) Mean tumor volume (6B, 6D) in BPLER tumor-bearing mice after treatment with bortezomib or DMSO at the indicated dose, schedule and route of administration. Median tumor weight was measured at time of sacrifice (6C, 6E). Immunohistochemistry of BPLER tumors treated intratumorally with 0.8 mg/kg bortezomib or DMSO q3d, showed caspase-3 cleavage in residual epithelial cells in bortezomib treated tumors. (6F) Immunoblot analysis of protein lysates from BPLER tumors 18 hours after 1 intravenous dose of bortezomib at 1.6 mg/kg bortezomib or DMSO, showing efficient Noxa induction and caspase-3 and PARP1 cleavage after bortezomib treatment. (6G) Mean tumor volume in MB-468 tumor-bearing mice after intravenous treatment with 1.6 mg/kg bortezomib weekly. (6H) Schematic diagram illustrating generation of mouse TNBC primary tumor fragments for bortezomib-based therapy studies. Histological analysis of V22 mouse tumors sections showed typical features of human TNBC, including epithelial differentiation, scant stroma and CK-14 positive staining. 4T1-E tumors are shown as control. (6I, 6J) Mean V22 tumor volume (6I) after weekly intravenous infusion of bortezomib (1.6 mg/kg) or DMSO. Treatment was started 2 days after implantation of primary tumor fragments. Box-and-whisker plot (6J) shows median tumor weight at time of sacrifice. The top and the bottom of each box represent the $75^{th}$ and $25^{th}$ percentile of tumor weight, respectively. Upper and lower whiskers represent maximum and minimum tumor weight, respectively. The black horizontal band in each box corresponds to median tumor weight.

DETAILED DESCRIPTION

Figure 1A:
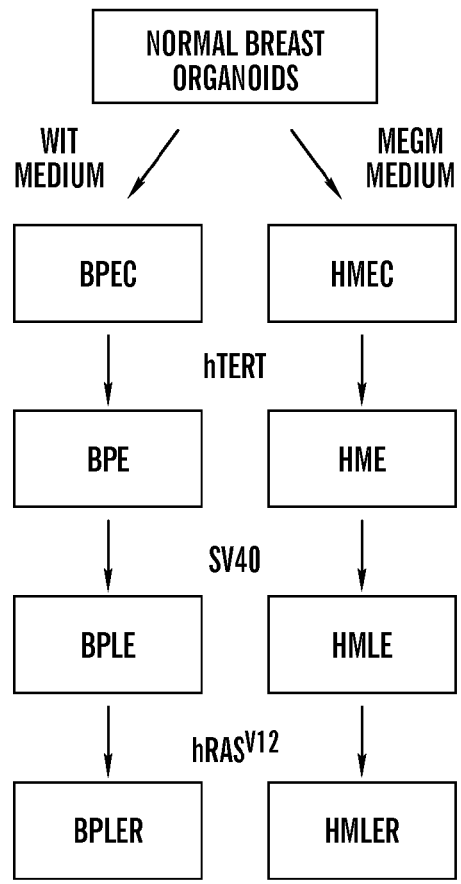
FIGS. 1A-1E demonstrate that BPLER cells are tumor-initiating epithelial progenitor cells that give rise to triple negative breast tumors. (1A) Schematic depicting the method of Ince and Weinberg[10] used to generate pairs of genetically identical breast cancer cell lines at different stages of transformation from normal breast epithelial cells. Breast organoids maintained in chemically defined media (WIT and MEGM) were sequentially transformed with retroviral vectors encoding hTERT, SV40 early region and RAS$^{V12}$. (1B) Both BPLER and HMLER are triple negative by qRT-PCR. Luminal MCF7, mesenchymal MDA-MB-231 and HER2+ SKBR3 cells were used as controls. (1C) CellTiterGlo assay showing similar proliferation rates of BPLER, HMLER and BPE cells in WIT medium. (1D) Tumor incidence in immunocompromised mice 8 weeks after injection of the indicated numbers of BPLER, HMLER or MCF7 cells in Nu/J mice. (1E) qRT-PCR quantification of epithelial TNBC markers in BPLER and HMLER cells. MCF7 and MDA-MB-231 cells were used as controls for luminal and mesenchymal lineage, respectively. Data for each gene here and in (1B) were normalized to β-actin and then to the highest value in the cells tested. Data in (1B, 1C, 1E) represent the mean+/−SD of 3 (1B, 1E) or 6 (1C) replicates. Immunofluorescent staining showed selective co-expression of CK14 and CK18 in BPLER cells. Data in (FIGS. 1B-1E) are representative of at least three independent experiments. Unsupervised hierarchical clustering of mRNA expression of six BPLER tumors that arose in immunodeficient mice and a set of 337 human breast primary tumors (UNC337 dataset[12]) was performed. BPLER tumors clustered with TNBC.

Provided herein are novel malignancy associated gene signature biomarkers, and assays and methods thereof, to classify prognosis or malignant potential of a cancer and identify cancer-initiating cells. Moreover, the gene signature biomarkers, assays and methods described herein provide, in part, new methodologies to screen for novel drugs for treating cancers and tumors, such as, for example, triple-negative breast tumors. Using the assays and methods described herein proteasome inhibitors, histone deacetylase inhibitors, glycolysis inhibitors, or any combination thereof, were identified as being highly effective in altering gene expression signatures specifically in malignant or cancer-initiating cells.

The invention is based, at least in part, on results from a genome-wide siRNA lethality screen using highly malignant progenitor-like human breast epithelial cells, which recapitulate several basal-like features and give rise to tumors closely resembling human primary triple-negative breast cancer cells, or TNBCs, such as basal-like breast tumors. As demonstrated herein, core survival pathways and a "malignancy associated response gene signature" selectively associated with cancer-initiating potential were identified that are useful for prognostic and diagnostic applications and reveal novel therapeutic targets for more effective and enhanced treatment of poor prognosis tumors, such as triple negative breast cancers.

Triple-negative breast cancers (TNBCs), such as basal-like breast tumors (BL-BTs), are an especially aggressive group of tumors with the shortest survival of all breast cancer subtypes. These tumors are enriched, in part, in breast tumor-initiating cells (BT-ICs), rapidly acquire resistance to chemotherapy, and are refractory to endocrine therapy and HER-2 inhibitors. No biologic therapy is currently available for these tumors.

As demonstrated herein, we discovered that a defined population of human progenitor-like breast primary epithelial cells acquire cancer initiating properties and give rise to triple-negative, basal-like breast tumors upon transformation with defined genetic elements, i.e., expression of certain specific genes. As shown herein, the induction of a cancer-initiating cell phenotype, such as that of a basal-like breast tumor initiating cell, depends on the cell of origin, because transformation of syngeneic myoepithelial-like cells with the same set of genetic elements does not induce such phenotypes.

We performed a genome-wide siRNA lethality screen to identify factors or biomarkers on which these two cell types selectively depend for survival. As demonstrated herein, these studies identified a "malignancy associated gene signature" (MARS), or "triple negative breast cancer gene signature" (TGS), comprising an expression pattern of 10-154 biomarkers for cancer initiating cells, such as triple negative breast cancer initiating cells. We further determined that most of the genes required for survival of triple negative breast cancer initiating cells are typically up regulated in poor prognosis human primary breast tumors, including basal-like tumors and some Luminal B tumors, thus providing novel diagnostic and prognostic signatures, assays and methods, and therapeutic targets, as described herein. Core cancer-initiating cell specific survival pathways and biomarkers identified herein include, but are not limited to, the proteasome-ubiquitin system, metabolic genes, histone deacetylases, RNA splicing, and the glycolytic system, the transient inhibition of which, as shown herein, impacts triple negative breast cancer initiating cells, but did not impact normal breast epithelial cells or transformed luminal, myoepithelial or mesenchymal cells. Accordingly, also provided herein are malignancy associated response gene signatures, and assays and methods thereof, comprising subsets of biomarker genes belonging to each of these core survival pathways.

It was also determined that triple negative breast cancer initiating cells are selectively and specifically sensitive to proteasome inhibitor drugs, such as bortezomib. Proteasome inhibitor drugs were demonstrated to interfere with mitosis exit and induce Noxa-dependent apoptosis. Further, the results described herein demonstrate that the selective response of cancer initiating cells to proteasome inhibition is dependent on Noxa-mediated inactivation of MCL1 (SEQ ID NO: 134), a gene belong to the malignancy associated response gene signature of 154 biomarkers. As shown herein, transformed mammary epithelial cells as well as primary human epithelial breast cancer cells selectively depend on MCL1 or MCL-1, which is antagonized by Noxa, for survival and that proteasome inhibitor target Mcl-1 dependency in these cells. Silencing of MCL1 expression in breast cancer cell lines led to similar lethality of specific breast cancers subtypes as was shown herein with bortezomib. Thus, MCL-1 was identified as a novel target for cancer initiating cells that recapitulates the effects of proteasome inhibition. Histone deacetylase inhibitors were also found to be selectively cytotoxic for triple-negative breast cancers. As proteasome and histone deacetylase inhibitors are already in the clinic, the findings described herein can be further developed for use in new indications and targeted diagnosis of and therapeutic treatments for poor prognosis cancers, such as triple negative breast cancers, in clinical settings.

Malignancy Associated Response Signatures and Assays and Methods Thereof

Provided herein are malignancy associated response signature for identification of cancer initiating cells and malignancy potential and cancer prognosis. These malignancy associated response signatures provide novel and unique combinations of biomarkers specifically required for the survival of cancer-initiating cells, such as triple-negative breast cancer initiating cells. The signatures also provide novel assays and methods for classifying cancers and determining cancer prognosis.

As used herein, a "malignancy-associated response signature" ("MARS") (also referred to herein as a "triple negative breast cancer gene signature" (TGS)) refers to a functional module of increased gene expression associated with cancer-initiating potential comprising at least two or more of the biomarkers provided in Table 3 (SEQ ID NOs: 1-154), termed herein as "malignancy associated response signature genes" or "malignancy associated response biomarkers." As described herein, a cancer or tumor, such as a breast cancer, can be classified as MARS (+) or MARS(−), or classified as comprising cancer initiating cells, having poor prognosis or as being malignant, by assessing the expression levels of at least two or more, preferably at least 10, of the 154 malignancy associated response signature genes or biomarkers provided herein in Table 3 (SEQ ID NOs: 1-154) in any combination, or in combination with any other prognostic or diagnostic biomarker known to one of skill in the art. Preferably, expression levels of at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 23, at least 25, at least 30, at least 35, at least 40, at least 45, at least 50, at least 100, at least 125, at least 130, at least 135, at least 140, at least 145, at least 150, or more, or all of the 154 malignancy associated response signature genes described herein are assessed. In some embodiments of all the aspects described herein, 5-20, 10-15, 10-20, 10-25 malignancy associated signature genes are used to analyze the unknown cancer cell for its prognosis. If at least 60% of the signature genes are expressed more than a control non-poor prognosis cell, i.e., the expression is increased, the tumor or cancer from which the cell or sample originated is considered to have poor prognosis. It is also well within the ability of one skilled in the art, using the teachings provided herein, to identify additional genes having prognostic or predictive value for use with signatures and assays and methods thereof described herein.

It is envisioned that any of the genes listed in Table 3 (SEQ ID NOs: 1-154, SEQ ID NOs: 181-184) can be used in the assays and methods described herein, either alone or in combination with any other malignancy associated response signature biomarker or other prognostic marker. Although information concerning the expression of as few as one biomarker is expected to provide useful information, confidence in the accuracy of the classification of a cancer or tumor as MARS(+) or MARS(−) increases when more biomarkers are included. Preferably at least 10 or more of the 154 TGS biomarkers listed in Table 3 (SEQ ID NOs: 1-154, SEQ ID NOs: 181-184) are used in prognostic and diagnostic analyses of a cancer sample as described herein. Cancers can be analyzed with respect to the expression of specific groups or subsets, of MARS biomarkers, including from SEQ ID NO: 1 to SEQ ID NO: 154 of the genes listed in Table 3, in any combination.

Figure 3:
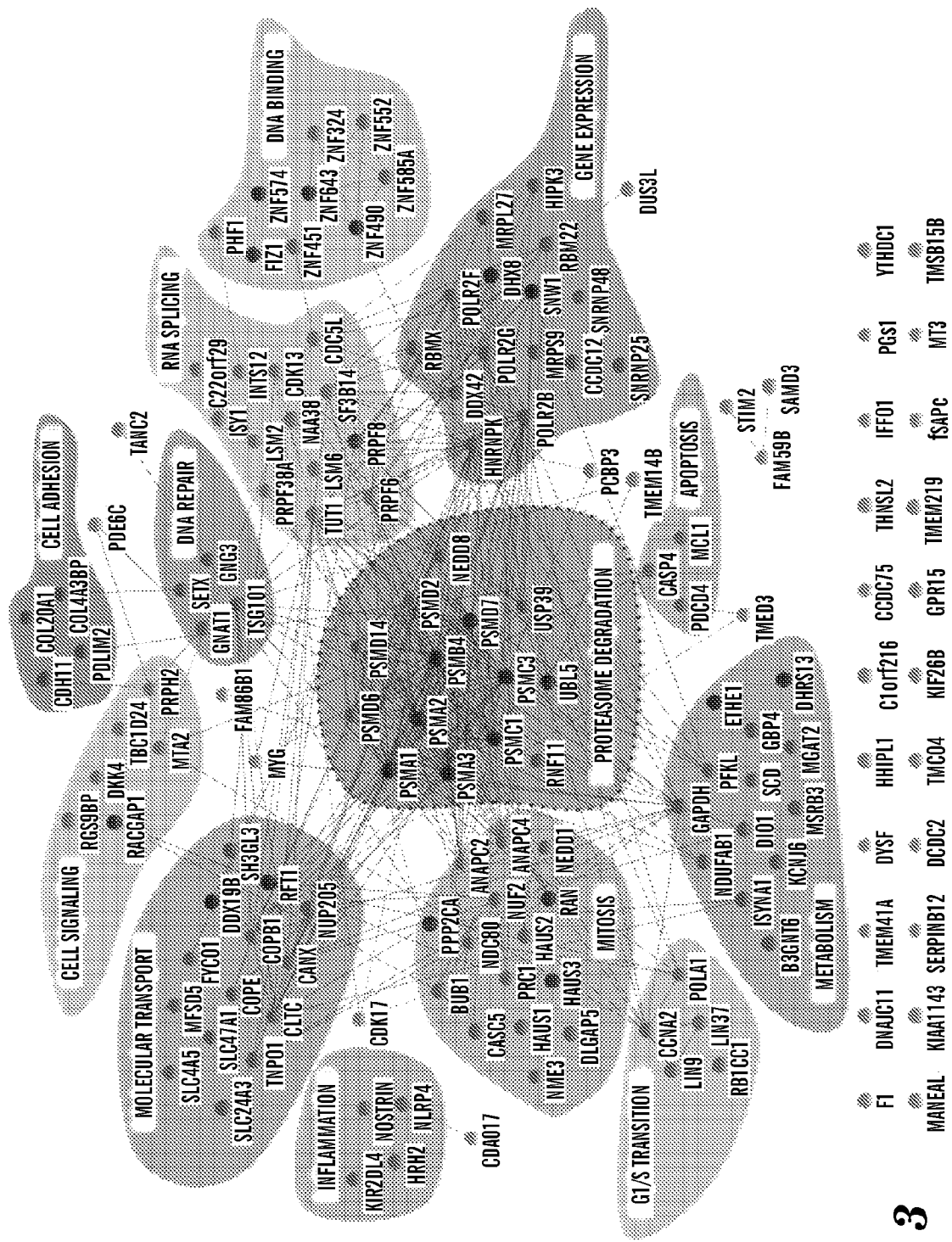
FIG. 3 depicts a malignancy associated response signature functional interaction network. The malignancy associated response signature interaction network was constructed by incorporating physical and predicted interactions, co-localization, shared pathways and shared protein domains, compiled from a variety of genomic and proteomic sources using GeneMANIA[20]. Genes were shaded according to their participation in the indicated processes. The network was constructed using Cytoscape[40].

For example, in some aspects and embodiments, a malignancy associated response signature can comprise only or consist essentially of genes or biomarkers involved in a specific pathway, such as the exemplary survival pathways depicted in FIG. 3, e.g., the proteasomal pathway. In some aspects and embodiments, a malignancy associated response signature can comprise or consist essentially of the 23 biomarkers of Table 2A (SEQ ID NOs: 1-4, 6, 7, 13, 14, 23, 29, 33-35, 37, 38, 66, 72, 77, 78, 84, 91, 93, and 151) described herein as having high specificity or high selectivity for cancer-initiating potential or cells. It is well within the ability of one of skill in the art to select specific combinations of MARS genes for analysis from among the genes listed in Table 3 (SEQ ID NOs: 1-154). In the interest of brevity, every possible combination of genes suitable for use in the methods described herein are not expressly listed. Nevertheless, it should be understood that every such combination is contemplated and is within the scope of the methods described herein. It is specifically envisioned that any combination of MARS biomarkers found to be differentially expressed in poor prognosis cancers, for example, triple negative breast cancer samples, are particularly useful for analysis and in the methods described herein.

Accordingly, in some aspects provided herein are malignancy associated response signatures for a cancer initiating cell, such as a breast cancer initiating cell, comprising or consisting essentially of an expression pattern or expression pattern analysis of a set of at least ten biomarkers set forth in SEQ ID NOs: 1-154, where at least 10 of the 154 biomarkers have increased expression or are increased compared to a reference value from a reference tissue or sample. In those embodiments of the aspects described herein, where a malignancy associated response signature is said to consist essentially of a particular set of biomarkers, one of skill in the art will understand that additional control genes, control well, replicates, or the like biomarkers can be added to the signature for the purposes described herein.

In some embodiments of these aspects, at least two of the set of at least ten biomarkers set forth in SEQ ID NOs: 1-154 is selected from the group consisting of SEQ ID NOs: 1-4, 6, 7, 13, 14, 23, 29, 33-35, 37, 38, 66, 72, 77, 78, 84, 91, 93, and 151.

In some embodiments of these aspects and all such aspects described herein, the expression of the at least ten biomarker is increased at least 1.8 fold compared to the reference value.

The 23 biomarkers of Table 2A (SEQ ID NOs: 1-4, 6, 7, 13, 14, 23, 29, 33-35, 37, 38, 66, 72, 77, 78, 84, 91, 93, and 151) were determined to have high specificity or high selectivity for cancer-initiating potential or malignant potential of cells, as described herein. Accordingly, in some aspects, provided herein are malignancy associated response signatures for a cancer-initiating cell comprising or consisting essentially of an expression pattern of a set of at least five biomarkers set forth in SEQ ID NOs: 1-4, 6, 7, 13, 14, 23, 29, 33-35, 37, 38, 66, 72, 77, 78, 84, 91, 93, and 151, where at least five of the 23 biomarkers have increased expression compared to a reference value. The number of biomarkers selected for expression analysis can be at least 4, at least 5, at least 6, at least 7, at least 8, least 9, at least 10, at least 11, at least 12, at least 13, least 14, at least 15, at least 16, at least 17, at least 18, least 19, at least 20, at least 21, at least 22, or include all 23 biomarkers, in different embodiments.

In some embodiments of these aspects and all such aspects described herein, the expression of the at least five of the 23 biomarkers is increased at least 1.8 fold compared to the reference value.

The term "expression" refers to the cellular processes involved in producing RNA and proteins and as appropriate, secreting proteins, including where applicable, but not limited to, for example, transcription, translation, folding, modification and processing. "Expression products" include RNA transcribed from a gene and polypeptides obtained by translation of mRNA transcribed from a gene, and such expression can be detected using methods known to one of skill in the art. Accordingly, an "expression pattern," as used herein, refers to a specific, defined subset of genes or biomarkers of a given malignancy associated response signature being expressed or not expressed by a cell or cellular sample.

The terms "increased," "increase" or "enhance" in connection with expression of the malignancy associated response signature markers are all used herein to generally mean an increase by a statically significant amount. For the avoidance of any doubt, the terms "increased", "increase" or "enhance" or "activate" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference value or level, or at least about a 1.5-fold, at least about a 1.6-fold, at least about a 1.7-fold, at least about a 1.8-fold, at least about a 1.9-fold, at least about a 2-fold, at least about a 3-fold, or at least about a 4-fold, or at least about a 5-fold, at least about a 10-fold increase, any increase between 2-fold and 10-fold, at least about a 25-fold increase, or greater as compared to a reference level. In some embodiments, an increase is at least about 1.8-fold increase over a reference value.

As is understood by one of ordinary skill in the art, the degree to which increased expression can be detected is dependent on the methodology used for measuring expression of a signature biomarker. Microarray platforms, for example, which can comprise many thousands of probes corresponding to a particular biomarker, can detect even subtle changes in gene expression, such that a 1.5-fold or greater change in expression is deemed significant, as described herein. PCR based platforms, including real-time quantitative analyses, are also highly sensitive to such small changes in gene expression. Other methods of detecting or measuring changes in gene expression, such as, for example, Northern blot analyses are not as sensitive, such that small increases are generally not thought to be reliable or valid. Similarly, protein based assays used to detect changes in expression of proteins corresponding to the malignancy associated response signatures have varying sensitivities. Thus, the degree to which increased expression is considered significant can vary depending on the nature of the techniques used to measure expression, and one of ordinary skill in the art will understand this and choose a suitable platform and statistical analysis when detecting expression of the signature biomarkers, using the methods and assays described herein.

Similarly, the terms "decrease," "reduced," "reduction," or "decrease" in connection with expression of the malignancy associated response signature markers are all used herein generally to refer to a decrease by a statistically significant amount. However, for avoidance of doubt, "reduced", "reduction" or "decrease" or "inhibit" means a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (e.g. absent level or non-detectable level as compared to a reference sample), or any decrease between 10-100% as compared to a reference level.

The results described herein revealed that the 154 genes found in the siRNA lethality screen to be selectively required for survival of cells with malignant potential or cancer initiating cells, fall into a specific groups of pathways, such as those shown in FIG. 3. Thus, in some aspects and embodiments, a malignancy associated response signature can comprise or consist essentially of specific subsets of the 154 biomarkers all related to a specific cellular function or pathway. Examples of such pathways or functions include, but are not limited to, proteasome degradation, gene expression, DNA binding, DNA repair, RNA splicing, apoptosis, cell adhesion, cell signaling, molecular transport, inflammation, mitosis, G1/S transition, metabolism, and the like. By determining expression patterns of genes belonging to particular pathways, targeted therapies can be selected, as described elsewhere herein. For example, in some aspects and embodiments described herein, malignancy associated response signature biomarkers for expression analysis include subunits of the ubiquitin-proteasome complex listed in Table 3 including, but not limited to, PSMA1 (SEQ ID NO: 2), PSMA2 (SEQ ID NO: 33), PSMA3 (SEQ ID NO: 7), PSMB4 (SEQ ID NO: 1), PSMC1 (SEQ ID NO: 38), PSMC3 (SEQ ID NO: 4), PSMD2 (SEQ ID NO: 15), PSMD7 (SEQ ID NO: 34), PSMD14 (SEQ ID NO: 16), UBL5 (SEQ ID NO: 29), NEDD1 (SEQ ID NO: 149), NEDD8 (SEQ ID NO: 76), ANAPC2 (SEQ ID NO: 68), and ANAPC4 (SEQ ID NO: 101).

Accordingly, in some aspects, provided herein are malignancy associated response signatures for a cancer-initiating cell susceptible to proteasomal gene inhibition comprising or consisting essentially of an expression pattern of a set of at least 3 biomarkers set forth in SEQ ID NOs: 1, 2, 4, 7, 15, 16, 21, 29, 33, 34, 38, 60, 74, 76, and 149, where at least 3 of the 15 biomarkers have increased expression compared to a reference value. The number of biomarkers selected for expression analysis can be at least 4, at least 5, at least 6, at least 7, at least 8, least 9, at least 10, at least 11, at least 12, at least 13, least 14, or include all 15.

In some aspects, provided herein are malignancy associated response signature for a cancer-initiating cell susceptible to mitosis gene inhibition comprising or consisting essentially of an expression pattern of a set of at least 3 biomarkers set forth in SEQ ID NOs: 9, 17, 22, 23, 31, 37, 35, 52, 68, 80, 101, 124, 130, and 137, where at least 3 of the 14 biomarkers have increased expression compared to a reference value. The number of biomarkers selected for expression analysis can be at least 4, at least 5, at least 6, at least 7, at least 8, least 9, at least 10, at least 11, at least 12, at least 13, or include all 14.

In some aspects, provided herein are malignancy associated response signatures for a cancer-initiating cell susceptible to RNA splicing gene inhibition comprising or consisting essentially of an expression pattern of a set of at least 3 biomarkers set forth in SEQ ID NOs: 5, 10, 11, 18, 20, 26, 36, 41, 57, 61, 123, 127, and 151, where at least 3 of the 13 biomarkers have increased expression compared to a reference value. The number of biomarkers selected for expression analysis can be at least 4, at least 5, at least 6, at least 7, at least 8, least 9, at least 10, at least 11, at least 12, or include all 13.

In some aspects, provided herein are malignancy associated response signatures for a cancer-initiating cell susceptible to molecular transport gene inhibition comprising or consisting essentially of an expression pattern of a set of at least 3 biomarkers set forth in SEQ ID NOs: 12, 13, 32, 48, 51, 56, 64, 91, 96, 98, 108, 121, and 147, where at least 3 of the 14 biomarkers have increased expression compared to a reference value. The number of biomarkers selected for expression analysis can be at least 4, at least 5, at least 6, at least 7, at least 8, least 9, at least 10, at least 11, at least 12, at least 13, or include all 14.

In some aspects, provided herein are malignancy associated response signatures for a cancer-initiating cell susceptible to metabolic gene inhibition comprising or consisting essentially of an expression pattern of a set of at least 3 biomarkers of SEQ ID NOs: 46, 49, 65, 69, 72, 78, 104, 107, 112, 126, 138, 141, and 153, where at least 3 of the 13 biomarkers have increased expression compared to a reference value. The number of biomarkers selected for expression analysis can be at least 4, at least 5, at least 6, at least 7, at least 8, least 9, at least 10, at least 11, at least 12, or include all 13.

Expression levels of a malignancy associated response signature biomarker can be determined by comparison to a suitable reference value, such that each of the expression levels of the at least two or more, e.g., 5 or more, 10 or more, malignancy associated response signature biomarker genes measured in a sample, such as a cellular sample, are compared to a specific reference level that acts a standard of comparison. The reference level is obtained or measured in a reference biological sample, such as a reference sample obtained from an age-matched normal control (e.g., an age-matched subject not having a breast cancer, or having a non-malignant or high prognosis breast cancer), or a reference sample from the same subject not from the tumor or cancer site, e.g., healthy breast tissue cells. A "reference value" is thus typically a predetermined reference level, such as an average or median of expression levels of each of the, for example, at least 2 of the 154 malignancy associated response signature associated biomarkers (SEQ ID NOs: 1-154) obtained from, for example, biological samples from a population of healthy subjects that are in the chronological age group matched with the chronological age of the tested subject. In some embodiments, the reference biological samples can also be gender matched. For example, as explained herein, malignancy associated response signature expression levels in a sample can be assessed relative to normal breast tissue from the same subject or from a sample from another subject or from a repository of normal subject samples. If the expression level of a malignancy associated response signature biomarker is greater or less than that of the reference or the average expression level of, for example, non-basal-like breast tumors of a particular type, the malignancy associated response signature biomarker expression is said to be "increased" or "decreased," respectively, as those terms are defined herein. Exemplary analytical methods for classifying expression of a malignancy associated response signature biomarker, determining a malignancy associated response signature status, and scoring of a sample for expression of a malignancy associated response signature biomarker are explained in detail herein.

Accordingly, in some embodiments of the malignancy associated response signatures described herein, an increased expression over a reference value is at least about a 1.5-fold increase, at least about a 1.6-fold increase, at least about a 1.7-fold increase, at least about a 1.8-fold increase, at least about a 1.9-fold increase, at least about a 2-fold increase, at least about a 3-fold increase, at least about a 4-fold increase, at least about a 5-fold increase, at least about a 10-fold increase, any increase between 1.5-fold and 10-fold, at least about a 25-fold increase, or greater as compared to a reference level. In some embodiments, an increase is at least about 1.8-fold increase over a reference value.

The malignancy associated response signatures and assays and methods thereof described herein are useful for identifying cancer-initiating cells and classifying cancers as having poor prognosis, high malignant potential, or comprising cancer-initiating cells, for example. "Cancer-initiating cells," which also include cancer stem cells, refer to cells that are neoplastic and can undergo self-renewal as well as abnormal proliferation and differentiation. Functional features of cancer-initiating cells are that they are tumorigenic, i.e., cause cancers or tumors. Such cancer-initiating cells can give rise to additional such neoplastic cells by self-renewal, and they can give rise to non-tumorigenic neoplastic cells. Without being bound to any particular theory, cancer initiating cells contribute to the development of metastatic cancer and relapses. The unique malignancy associated response signature biomarkers, described herein, permit specific therapies targeted at cancer-initiating cells.

Accordingly, in some embodiments of the malignancy associated response signatures, the cancer-initiating cell is a breast cancer-initiating cell. In some embodiments of the malignancy associated response signatures, the cancer-initiating cell is a triple-negative breast cancer-initiating cell. In some embodiments of the malignancy associated response signatures, the cancer-initiating cell is a Luminal B breast cancer-initiating cell. In some embodiments of the malignancy associated response signatures, the cancer-initiating cell is an epithelial breast cancer-initiating cell.

A "cancer" or "tumor" as used herein refers to an uncontrolled growth of cells which interferes with the normal functioning of the bodily organs and systems. A subject that has a cancer or a tumor is a subject having objectively measurable cancer cells present in the subject's body. Included in this definition are benign and malignant cancers, as well as dormant tumors or micrometastatses. Cancers which migrate from their original location and seed vital organs can eventually lead to the death of the subject through the functional deterioration of the affected organs. Hemopoietic cancers, such as leukemia, are able to out-compete the normal hemopoietic compartments in a subject, thereby leading to hemopoietic failure (in the form of anemia, thrombocytopenia and neutropenia) ultimately causing death.

By "metastasis" is meant the spread of cancer from its primary site to other places in the body. Cancer cells can break away from a primary tumor, penetrate into lymphatic and blood vessels, circulate through the bloodstream, and grow in a distant focus (metastasize) in normal tissues elsewhere in the body. Metastasis can be local or distant. Metastasis is a sequential process, contingent on tumor cells breaking off from the primary tumor, traveling through the bloodstream, and stopping at a distant site. At the new site, the cells establish a blood supply and can grow to form a life-threatening mass. Both stimulatory and inhibitory molecular pathways within the tumor cell regulate this behavior, and interactions between the tumor cell and host cells in the distant site are also significant.

Metastases are most often detected through the sole or combined use of magnetic resonance imaging (MRI) scans, computed tomography (CT) scans, blood and platelet counts, liver function studies, chest X-rays and bone scans, in addition to the monitoring of specific symptoms.

Examples of cancer for use in the methods of diagnosis, prognosis, and treatment described herein, include but are not limited to, carcinoma, lymphoma, blastoma, sarcoma, and leukemia. More particular examples of such cancers include, but are not limited to, breast cancer (including, e.g., triple negative breast cancers, basal-like breast cancers, Luminal B breast cancers); basal cell carcinoma, biliary tract cancer; bladder cancer; bone cancer; brain and CNS cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); lymphoma including Hodgkin's and non-Hodgkin's lymphoma; melanoma; myeloma; neuroblastoma; oral cavity cancer (e.g., lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; as well as other carcinomas and sarcomas; as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute lymphoblastic leukemia (ALL); Hairy cell leukemia; chronic myeloblastic leukemia; and post-transplant lymphoproliferative disorder (PTLD), as well as abnormal vascular proliferation associated with phakomatoses, edema (such as that associated with brain tumors), and Meigs' syndrome.

Also provided herein are assays and methods for classifying cancers in a subject based on expression analyses of various combinations of the biomarkers of the malignancy associated response signatures described herein. By classifying a cancer as having poor prognosis or malignant potential, and identifying pathways that are associated with poor prognosis or malignant potential, specific genes and biomarkers, such as those described herein, can be targeted, and specific therapies can be administered to a subject. A cancer or tumor, such as a breast cancer, can be classified as highly malignant or having poor prognosis by assessing and determining increased expression levels of at least two or more, preferably at least 10, of the 154 malignancy associated response signature genes or biomarkers listed in Table 3 (SEQ ID NOs: 1-154) in a biological sample in any combination, or in combination with any other prognostic biomarker known to one of skill in the art. Preferably, expression levels of at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 23, at least 25, at least 30, at least 35, at least 40, at least 45, at least 50, at least 100, at least 125, or more of the 154 malignancy associated response signatures genes described herein are assessed. It is well within the ability of one skilled in the art, using the teachings provided herein, to identify additional genes having prognostic or predictive value for use with the assays and methods described herein.

Accordingly, in some aspects, provided herein are methods of classifying a cancer in a subject in need thereof, such methods comprising:
a. assaying expression of ten or more of the 154 malignancy associated response signature biomarkers of SEQ ID NOs: 1-154 in a biological sample obtained from the subject having a cancer, and
b. comparing the expression of the ten or more of the 154 malignancy associated response signature biomarkers of SEQ ID NOs: 1-154 in the biological sample obtained from the subject having a cancer with a reference value, such that increased expression of 1.8-fold or greater of at least ten of the biomarkers in the biological sample obtained from the subject relative to the reference value indicates that the cancer is classified as having a poor prognosis or being a malignant cancer, and absence of increased expression of 1.8-fold or greater of at least ten of the biomarkers relative to the reference value indicates that the cancer does not have poor prognosis or is not a malignant cancer.

In some aspects, provided herein are methods of classifying a cancer in a subject in need thereof, such methods comprising:
a. assaying expression of at least five biomarkers set forth in SEQ ID NOs: 1-4, 6, 7, 13, 14, 23, 29, 33-35, 37, 38, 66, 72, 77, 78, 84, 91, 93, and 151 in a biological sample obtained from the subject having a cancer, and
b. comparing the expression of the five or more of the 23 malignancy associated response signature biomarkers in the biological sample obtained from the subject having a cancer with a reference value, wherein increased expression of 1.8-fold or greater of at least ten of the biomarkers in the biological sample obtained from the subject relative to the reference value indicates that the cancer is classified as having a poor prognosis or being a malignant cancer, and absence of increased expression of 1.8-fold or greater of at least ten of the biomarkers relative to the reference value indicates that the cancer does not have poor prognosis or is not a malignant cancer.

In some aspects, provided herein are methods of classifying a cancer in a subject in need thereof, the method comprising:
a. assaying expression of at least three malignancy associated response signature biomarkers set forth in SEQ ID NOs: 1, 2, 4, 7, 15, 16, 21, 29, 33, 34, 38, 60, 74, 76, and 149 in a biological sample obtained from the subject having a cancer, and
b. comparing the expression of the at least three malignancy associated response signature biomarkers in the biological sample obtained from the subject having a cancer with a reference value, wherein increased expression of 1.8-fold or greater of at least three of the biomarkers in the biological sample obtained from the subject relative to the reference value indicates that the cancer is classified as having a poor prognosis or being a malignant cancer, and absence of increased expression of 1.8-fold or greater of at least three of the biomarkers relative to the reference value indicates that the cancer does not have poor prognosis or is not a malignant cancer.

Also provided herein, in some aspects, are assays for determining cancer prognosis in a subject. Such assays comprise the steps of:
a. measuring expression of ten or more of the 154 malignancy associated response signature biomarkers set forth in SEQ ID NOs: 1-154 in a biological sample obtained from a subject having cancer, and
b. comparing the expression of the ten or more of the 154 malignancy associated response signature biomarkers set forth in SEQ ID NOs: 1-154 in the biological sample obtained from the subject having a cancer with a reference value, wherein increased expression of at least ten of the measured biomarkers in the biological sample obtained from the subject relative to the reference value diagnoses the patient as having a poor prognosis or malignant cancer, and absence of increased expression of at least ten of the measured biomarkers relative to the reference value diagnoses the patient as not having a poor prognosis or malignant cancer.

In some embodiments of these methods and assays, the cancer is a breast cancer. In some embodiments of these methods and assays, the cancer is a triple-negative breast cancer. In some embodiments of these methods and assays, the cancer is a Luminal B breast cancer. In some embodiments of these methods and assays, the cancer is an epithelial breast cancer.

In some embodiments of these assays and methods, increased expression of the two or more of the 154 malignancy associated response signature biomarkers, or a subset thereof, in the biological sample classifies the cancer or determines a prognosis for the subject having the cancer. In some such embodiments, the prognosis comprises relative survival rate, relative risk of metastasis, treatment option, or any combination thereof.

As demonstrated herein, the described malignancy associated response signature biomarker genes have prognostic value. The term "prognosis," as used herein, refers to prediction of a cancer attributable progression. Prognosis includes, but is not limited to the survival rate and risk of recurrence, metastatic spread, treatment resistance, and local-regional failure. In the examples described herein, increased expression and enrichment of malignancy associated response signature biomarkers in luminal B subtype breast tumors was found to correlate with decreased survival. In breast cancer patients, enriched expression of malignancy associated response signature genes was found to correlate with increased risk and onset of metastasis, and decreased metastasis-free survival. Accordingly, expression of malignancy associated response signature biomarkers in a tumor sample can be used clinically as both a predictive and prognostic marker to provide information concerning appropriate treatment modalities and likely treatment outcome. The expression of malignancy associated response signature biomarkers can be used in conjunction with other prognostic factors, in some embodiments, to allow a clinician to predict the outcome of a cancer treatment. The stratification of patients based on enriched expression of malignancy associated response signature biomarkers can be used to determine a treatment protocol for the patients. For example, patients can be divided into those who have a low risk for metastasis and can be spared specific therapies, those with high risk for metastasis who are likely to benefit from standard treatments, and those with a high risk for metastasis and who are resistant to standard treatments. Such stratification permits tailoring of patient treatment protocols to the individual patient.

The terms "subject," "patient," and "individual" are used interchangeably herein, and refer to an animal, for example a human. For treatment of those disease states which are specific for a specific animal such as a human subject, the term "subject" refers to that specific animal. The terms 'non-human animals' and 'non-human mammals' are used interchangeably herein, and include mammals such as rats, mice, rabbits, sheep, cats, dogs, cows, pigs, and non-human primates. The term "subject" also encompasses any vertebrate including but not limited to mammals, reptiles, amphibians and fish. In some embodiments of the aspects described herein, a subject refers to a human subject having a breast cancer or at increased risk for a breast cancer. A subject that has a breast cancer or a tumor is a subject having objectively measurable breast cancer cells present in the subject's body.

As used herein, the term "biological sample" or "subject sample" or "sample" refers to a cell or population of cells or a quantity of tissue or fluid obtained from a subject. Most often, the sample has been removed from a subject, but the term "biological sample" can also refer to cells or tissue analyzed in vivo, i.e. without removal from the subject. A biological sample or tissue sample includes, but is not limited to, blood, plasma, serum, lymph fluid, bone marrow, tumor biopsy, urine, stool, sputum, cerebrospinal fluid, pleural fluid, nipple aspirates, lymph fluid, the external sections of the skin, lung tissue, adipose tissue, connective tissue, sub-epithelial tissue, epithelial tissue, liver tissue, kidney tissue, uterine tissue, respiratory tissues, breast tissue, gastrointestinal tissue, and genitourinary tract tissue, tears, saliva, milk, cells (including, but not limited to, blood cells), biopsies, scrapes (e.g., buccal scrapes), tumors, organs, and also samples of an in vitro cell culture constituent. Often, a "biological sample" will contain cells from the subject, but the term can also refer to non-cellular biological material, such as non-cellular fractions of blood, saliva, or urine. In some embodiments, the sample is from a resection, or core needle biopsy of a primary or metastatic tumor, such as a breast tumor, or a cell block from pleural fluid. In some embodiments, fine needle aspirate samples are used. Samples can be paraffin-embedded or frozen tissue.

In another aspect, provided herein are methods of determining the type or prognosis of a tumor from a patient, the methods comprising detecting expression of ten or more of the 154 triple negative breast cancer gene signature genes of Table 3 (SEQ ID NOs: 1-154) in a biological sample from a subject affected with or having a tumor, wherein increased expression of the genes relative to a reference sample indicates that the tumor is a poor prognosis tumor, such as a triple-negative tumor or basal-like breast tumor, and absence of increased expression of the genes relative to the reference indicates that the tumor is not a poor prognosis tumor.

In other aspects, provided herein are methods of determining the type of a breast tumor from a patient comprising detecting expression of ten or more of the 154 triple negative breast cancer gene signature genes of Table 3 (SEQ ID NOs: 1-154) in a biological sample from a subject affected with or having a triple-negative breast cancer, wherein increased expression of the genes relative to a reference sample indicates that the triple-negative breast cancer is a basal-like breast tumor or poor prognosis luminal B breast tumor, and absence of increased expression of the genes relative to the reference indicates that the tumor is not a basal-like breast tumor or a poor prognosis luminal B breast tumor.

In some embodiments of these aspects and all such aspects described herein, the methods and assays further comprise the step of administering at least one proteasome inhibitor to the subject having been determined to carry a poor prognosis tumor, a triple-negative tumor, a basal-like breast tumor, or a poor prognosis luminal B breast tumor. In some embodiments, the proteasome inhibitor is bortezomib. In some embodiments, the proteasome inhibitor is an siRNA or antisense RNA agent.

In some embodiments of these aspects and all such aspects described herein, the method further comprises the step of administering at least one histone deactylase inhibitor to the subject having been determined to carry a poor prognosis tumor, a triple-negative breast cancer, a basal-like breast tumor, or a poor prognosis luminal B breast tumor. In some such embodiments, the histone deactylase inhibitor is Trichostatin A. In some such embodiments, the histone deactylase inhibitor is Vorinostat. In some embodiments, the histone deactylase inhibitor is an siRNA or antisense RNA agent.

In some embodiments of these aspects and all such aspects described herein, the method further comprises the step of administering at least one glycolysis inhibitor to the subject having been determined to carry a poor prognosis tumor, a triple-negative breast cancer, a basal-like breast tumor, or a poor prognosis luminal B breast tumor. In some such embodiments, the glycolysis inhibitor is 3-bromopyruvic acid (BRPA). In some embodiments, the glycolysis inhibitor is an siRNA or antisense RNA agent.

In various embodiments of the aspects described herein, expression levels of the TGS biomarkers in a biological sample can be evaluated by any suitable means known to one of skill in the art. For example, in some embodiments, expression can be evaluated using DNA microarrays. Alternatively, in other embodiments, RNA transcripts can be measured using real time PCR, or protein products can be detected using suitable antibodies. Methods of determining expression levels of genes by these and other methods are known in the art.

In some embodiments of these aspects and all such aspects described herein, the expression levels of the at least two or more, e.g., 10 or more, malignancy associated response signature biomarker genes measured in a biological sample are compared to a reference level, or a reference biological sample, such as biological sample obtained from an age-matched normal control (e.g., an age-matched subject not having a breast cancer, or having a non-malignant or high prognosis breast cancer), or a biological sample from the same subject not from the tumor or cancer site, e.g., healthy breast tissue cells. For diagnosing or determining a prognosis of a subject having a breast cancer in a subject using the methods and systems as disclosed herein, a "reference value" is typically a predetermined reference level, such as an average or median of expression levels of the at least 2 of the 154 malignancy associated response signature biomarkers (SEQ ID NOs: 1-154) obtained from biological samples from a population of healthy subjects that are in the chronological age group matched with the chronological age of the tested subject. As indicated earlier, in some situations, the reference biological samples can also be gender matched.

Also provided herein are assays for determining or identifying whether a sample from a subject, such as a biopsy sample, comprises cancer initiating cells. Such assays are based, in part, on the high-throughput siRNA lethality screen described herein, where different cancer types were assessed for differential susceptibility to gene inhibition using a library of different siRNA sequences targeted to different genes.

Such assays comprise the steps of: (a) dividing a cell culture grown from a biopsy obtained from a subject having cancer into at least 5 separate cultures; (b) exposing each of the at least 5 separate cultures to a different inhibitory agent, such that each of the different inhibitory agent specifically inhibits a different malignancy associated response signature biomarker set forth in SEQ ID NOs: 1-154; (c) growing each of the at least 5 separate cell cultures of step (b) for at least 12 hours; and (d) measuring viability of the cells from each of the cultures of step (c), such that if the total viability of the cells in at least 60% of the cultures is decreased by at least 25%, then the biopsy obtained from the subject comprises cancer-initiating cells.

Viability, as used herein refers, to the number of living cells present in a culture at a given timepoint. Viability can be measured using any of the assays set forth herein, such as those described in the Examples section. Exemplary viability assays include Trypan Blue staining, flow cytometric analyses of annexin V, propidium iodide staining and the like.

Cells can be cultured according to standard methods known to one of skill in the art, and the duration of culture can vary. Preferably a culture for identifying whether a sample comprises cancer-initiating cells is grown for at least 6 hours, at least 12 hours, at least 18 hours, at least 24 hours, at least 30 hours, at least 36 hours, at least 42 hours, at least 48 hours, at least 54 hours, at least 60 hours, at least 66 hours, at least 72 hours, at least 84 hours, at least 96 hours, at least 108 hours, at least 120 hours, or more. As understood by one of ordinary skill in the art, culture itself can cause loss in viability of cells, due, for example, to overcrowding in a dish or well, and thus the cultures should be grown for long enough to identify and measure any effect(s) on the cells from the inhibitory agent to which the cells have been exposed, but not so long as to mask any such effects due, for example, to overcrowding.

In some embodiments of these assays and all such assays described herein, the inhibitory agents are selected from siRNA agents, antisense RNA agents, or small molecules, that specifically inhibit any of the cancer gene signature biomarkers set forth in SEQ ID NOs: 1-154.

In some embodiments of these assays and all such assays described herein, the inhibitory agents specifically inhibit any of the malignancy associated response signature biomarkers set forth in SEQ ID NOs: 1-4, 6, 7, 13, 14, 23, 29, 33-35, 37, 38, 66, 72, 77, 78, 84, 91, 93, and 151.

In some embodiments of these assays and all such assays described herein, at least one inhibitory agent specifically inhibits any of the malignancy associated response signature biomarkers set forth in SEQ ID NOs: 1-4, 6, 7, 13, 14, 23, 29, 33-35, 37, 38, 66, 72, 77, 78, 84, 91, 93, and 151.

In some embodiments of these assays and all such assays described herein, at least one inhibitory agent specifically inhibits any of the proteasomal malignancy associated response signature biomarkers set forth in SEQ ID NOs: 1, 2, 4, 7, 15, 16, 21, 29, 33, 34, 38, 60, 74, 76, and 149.

In some embodiments of these assays and all such assays described herein, at least one inhibitory agent specifically inhibits any of the mitosis cancer gene signature biomarkers set forth in SEQ ID NOs: 9, 17, 22, 23, 31, 37, 35, 52, 68, 80, 101, 124, 130, and 137.

In some embodiments of these assays and all such assays described herein, at least one inhibitory agent specifically inhibits any of the RNA splicing malignancy associated response signature biomarkers set forth in SEQ ID NOs: 5, 10, 11, 18, 20, 26, 36, 41, 57, 61, 123, 127, and 151.

In some embodiments of these assays and all such assays described herein, at least one inhibitory agent specifically inhibits any of the molecular transport malignancy associated response signature biomarkers set forth in SEQ ID NOs: 12, 13, 32, 48, 51, 56, 64, 91, 96, 98, 108, 121, and 147.

In some embodiments of these assays and all such assays described herein, at least one inhibitory agent specifically inhibits any of the metabolic malignancy associated response signature biomarkers set forth in SEQ ID NOs: 46, 49, 65, 69, 72, 78, 104, 107, 112, 126, 138, 141, and 153.

In some embodiments of the aspects described herein, the assays and methods for classifying a cancer, determining whether a sample comprises cancer-initiating cells, determining or diagnosing the type of a cancer or tumor from a patient, providing a prognosis to a cancer patient, or treating a cancer patient, further comprise the step of selecting or identifying the subject having the cancer. In such embodiments, a subject is identified as having cancer by objective determination of the presence of cancer cells or a tumor in the subject's body by one of skill in the art. Such objective determinations can be performed through the sole or combined use of manual examination, tissue biopsies, blood and platelet cell counts, mammograms, ultrasound, urine analyses, magnetic resonance imaging (MRI) scans, computed tomography (CT) scans, liver function studies, chest X-rays and bone scans in addition to the monitoring of specific symptoms associated with the cancer.

Expression levels of a malignancy associated response signature biomarker can be determined by comparison to a suitable reference. For example, as explained herein, malignancy associated response signature biomarker expression levels in a sample can be assessed relative to normal breast tissue from the same subject or from a sample from another subject or from a repository of normal subject samples. Alternatively, the relative expression level of a malignancy associated response signature gene in a particular tumor can be determined with reference to the expression levels of the same gene in for example, non-basal-like breast tumors, e.g., HER2, luminal, or claudin-low breast cancers. If the expression level of a malignancy associated response signature gene is greater or less than that of the reference or the average expression level of non-basal-like breast tumors of a particular type, the malignancy associated response signature gene expression is said to be "increased" or "decreased," respectively, as those terms are defined herein.

In other aspects, provided herein are methods for diagnostic or prognostic analysis of a cancer, such as a breast cancer, in a subject comprising the step of measuring expression of at least 10 of the 154 genes of a malignancy associated response signature (SEQ ID NOs: 1-154) for a cancer-initiating cell in a biological sample, wherein said triple negative breast cancer gene signature comprises an expression pattern of a set of 10-154 biomarker genes set forth in Table 3 (SEQ ID NOs: 1-154), and wherein an increase of expression of at least 10 of the biomarker genes is indicative of poor prognosis of the cancer in the subject.

In some embodiments of this aspect, the expression of the at least 10 of the 154 biomarkers of the malignancy associated response signature in the biological sample determines a prognosis for the subject having the cancer. In some such embodiments, the prognosis comprises relative survival rate, relative risk of metastasis, treatment option, or any combination thereof.

In further embodiments of the prognostic methods described herein, the relative survival rate of a patient can be predicted by determining the expression of at least one, but preferably at least 10, malignancy associated response signature biomarkers in a tumor sample derived from a patient. Survival in cancer patients is often quantified as a "relative cancer survival rate." The relative cancer survival rate is the percentage of patients who survive a certain type of cancer for a specified amount of time. Cancer survival rates are often given in 5, 10 or 20 year survival rates. As seen in the examples described herein, enriched expression of malignancy associated response signature biomarkers can predict differential survival rates of patients with subgroups of Luminal B cancer, and metastasis-free survival rates in primary breast cancer samples.

Pathway Inhibitors & Therapeutic Methods

The various combinations of malignancy associated response signature biomarkers identified in the screens described herein provide novel therapeutic targets and pathways, such as the pathways highlighted in FIG. 3, e.g., ubiquitin-proteosome pathway, histone deactylase pathway, metabolic pathway, for treatment of subjects having cancers classified as malignant or poor prognosis, or having cancer-initiating cells, such as, for example, triple negative breast cancers.

Accordingly, in some embodiments, if a cancer is classified as having a poor prognosis or being a malignant cancer, or comprising cancer-initiating cells using, for example, the assays and methods for classifying cancers provided herein, at least one proteasome inhibitor is administered to the subject.

For example, in some embodiments, if the cancer is classified as having a poor prognosis or being a malignant cancer, or comprising cancer-initiating cells using, for example, the assays and methods for classifying cancers provided herein, such that at least 10 of the 154 genes of a malignancy associated response signature (SEQ ID NOs: 1-154) for a cancer-initiating cell in a biological sample have increased expression over a reference value, then at least one proteasome inhibitor is administered to the subject. In some such embodiments, if, in addition to the requirement that at least 10 of the 154 genes of a malignancy associated response signature (SEQ ID NOs: 1-154) are increased relative to reference value, at least two of the ten or more genes having increased expression are required to be proteasomal malignancy associated response signature biomarkers of SEQ ID NOs: 1, 2, 4, 7, 15, 16, 21, 29, 33, 34, 38, 60, 74, 76, and 149, then at least one proteasome inhibitor is administered to the subject.

Similarly, in some embodiments, if the cancer is classified as having a poor prognosis or being a malignant cancer, or comprising cancer-initiating cells using, for example, the assays and methods for classifying cancers provided herein, such that at least five of the biomarkers set forth in SEQ ID NOs: 1-4, 6, 7, 13, 14, 23, 29, 33-35, 37, 38, 66, 72, 77, 78, 84, 91, 93, and 151 have increased expression relative to a reference value, then at least one proteasome inhibitor is administered to the subject. In some such embodiments, if, in addition to the requirement that at least five of the 23 genes of the malignancy associated response signature are increased relative to reference value, at least one of the five or more genes having increased expression are required to be proteasomal malignancy associated response signature biomarkers of SEQ ID NOs: 1, 2, 4, 7, 29, 33, 34, and 38, then at least one proteasome inhibitor is administered to the subject.

The term "proteosome inhibitor," as used herein, relates to a compound or an agent which targets, decreases or inhibits one or more components of the proteosome or proteosomal pathway. The proteasome is an intracellular structure which is a multicatalytic proteinase which is a highly conserved. Proteasomes are responsible for the ATP-dependent proteolysis of many proteins involved in important regulatory cellular processes. Thus, the proteosome is a regulatory element in cell growth and differentiation. Several steps are involved in protein degradation via the proteasome or "ubiquitin-proteasome" pathway. Initially, a protein is marked for destruction with a chain of small polypeptides known as ubiquitin. Ubiquitinylation guides the protein into the proteosome's enclosed proteolytic chamber. Three enzymatic activities, E1, E2, and E3, are required for ubiquitinylation. The ATP-dependent E1 enzyme activates ubiquitin and links it to the ubiquitin-conjugating enzyme, E2. The E3 enzyme, an ubiquitin ligase, then links the ubiquitin molecule to the protein. This process is repeated until the designated polypeptide trails a long chain of ubiquitin moieties and the proteasome finally degrades the protein into small fragments. The ubiquitin-proteasome pathway is responsible for the degradation of 90% of all abnormal, misfolded proteins and all of the short-lived, regulatory proteins in the cell.

Examples of targets of a proteosome inhibitor include, but are not limited to, O(2)(−)-generating NADPH oxidase, NF-κB farnesyltransferase, and geranylgeranyltransferase I.

A variety of inhibitors of the proteasome complex have been reported, e.g., Dick, et al., Biochem. 30: 2725 (1991); Goldberg, et al., Nature 357: 375 (1992); Goldberg, Eur. J. Biochem. 203: 9 (1992); Orlowski, Biochem. 29: 10289 (1989); Rivett, et al., Archs. Biochem. Biophys. 218: 1 (1989); Rivett, et al., J. Biol. Chem. 264: 12, 215 (1989); Tanaka, et al., New Biol. 4: 1 (1992). Proteasome inhibitors are also discussed in U.S. Pat. No. 5,693,617, the disclosure of which is incorporated herein by reference. In addition to antibiotic inhibitors originally isolated from actinomycetes, a variety of peptide aldehydes have been synthesized, such as the inhibitors of chymotrypsin-like proteases described by Siman et al. (WO91/13904).

Specific proteasome inhibitors fall into five classes distinguished by the pharmacophore that interacts with the active site threonine in the proteasome: peptide aldehydes such as CEP1612 and MG132, peptide boronates such as bortezomib, peptide vinyl sulfones, peptide epoxyketones and β-lactone inhibitors such as lactocystin. In some embodiments of the aspects and embodiments provided herein, a proteasome inhibitor is bortezomib.

Examples of proteosome inhibitors or analogues thereof contemplated for use in the methods described herein include, but are not limited to, aclacinomycin A; MG-132; gliotoxin; PS-341; MLN 341; peptide aldehydes, e.g., N-acetyl-leucinyl-leucynil-norleucynal, N-acetyl-leucinyl leucynil-methional, carbobenzoxyl-leucinyl-leucynil-norvalinal, carbobenzoxyl-leucinyl-leucynil-leucynal, lactacystine, b-lactone; boronic acid peptides; ubiquitin ligase inhibitors; PS-519 (1R-[1S,4R,5S]]-1-(1-hydroxy-2-methylpropyl)-4-propyl-6-oxa-2-azabicyclo[-3.2.1.]heptane-3,7-dione); clasto-lactacystin beta-lactone; lactacystin; epoxomicin; CVT634 (-5-methoxy-1-indanone-3-acetyl-leucyl-D-leucyl-1-indanylamide); TMC96 ((3-methylbutanoyl-L-threonine N-(1-(2-(hydroxymethyl)-oxiran-2-ylcarbonyl)-3-methylbut-3enyl)amide); MG-115; CEP161; cyclosporin A; deoxyspergualin; bortezomib and/or compounds having structure similar to that of bortezomib; and Velcade. Proteasome inhibitors having structure similar to bortezomib include those compounds disclosed in U.S. Pat. Nos. 7,119, 080; 6,747,150; 6,617,317; 6,548,668; 6,465,433; 6,297, 217; 6,083,903; 5,780,454; 7,422,830; 7,109,323; 6,958, 319; 6,713,446; and 6,699,835, the contents of each of which are herein incorporated by reference in their entireties.

In addition to the proteasome protease inhibitors, the ubiquitin-proteasome pathway can be blocked by inhibitors of the facilitating enzymes Ubiquitin-activating enzyme (E1), ubiquitin-conjugating enzyme (E2), and ubiquitin-ligases (E3 enzymes). E1 inhibitors have been identified such as himeic acid A (Tsukamoto, et al. 2005, Bioorgan Med Chem Lett 15(1):191-194. Other methods known in the art, such as RNA mediated silencing or inhibition, can also be used to reduce or eliminate the activities of specific ubiquitinylation-related enzymes.

MCL1 (SEQ ID NO: 134) is a myeloid cell leukemia protein of the Bcl-2 family of proteins. Two alternatively spliced transcripts encoding distinct isoforms have been identified. The longer gene product (isoform 1) enhances cell survival by inhibiting apoptosis while the alternatively spliced shorter gene product (isoform 2) promotes apoptosis and is death-inducing. The results described herein identify MCL-1 as a malignancy associated response signature biomarker, and demonstrate that inhibition of MCL-1 has the same lethal effects as proteasome inhibition in poor prognosis cancer cells, such as triple-negative breast cancer cells. Accordingly, in some embodiments, a proteasome inhibitor is chosen that specifically inhibits MCL-1 of SEQ ID NO: 134 for use with the assays and methods described herein.

In some embodiments, the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149. In some embodiments, the at least one proteasome inhibitor specifically inhibits the malignancy associated response signature biomarker set forth in SEQ ID NO: 134 (MCL-1).

In some embodiments, the at least one proteasome inhibitor is an siRNA or antisense RNA agent.

In some embodiments, the at least one proteasome inhibitor is bortezomib.

In some embodiments of the methods and assays described herein, if a cancer is classified as having a poor prognosis or being a malignant cancer, at least one histone deacetylase inhibitor is administered to the subject having cancer. In some such embodiments, the at least one histone deacetylase inhibitor is an siRNA or antisense RNA agent. In some such embodiments, the at least one histone deacetylase inhibitor is trichostatin A (TSA) or Vorinostat.

The terms "histone deacetylase inhibitor" or "inhibitor of histone deacetylase," as used herein, relate to a compound or an agent which targets, decreases, or inhibits the activity or expression of one or more histone deacetylases or components of the histone deacetylase pathway. Inhibiting histone deacetylase enzymatic activity means reducing the ability of a histone deacetylase to remove an acetyl group from a histone or another protein substrate. Preferably, such inhibition is specific, i.e., the histone deacetylase inhibitor reduces the ability of a histone deacetylase to remove an acetyl group from a histone or another protein substrate at a concentration that is lower than the concentration of the inhibitor that is required to produce some other, unrelated biological effect. The terms "histone deacetylase" and "HDAC" are intended to refer to any one of a family of enzymes that remove acetyl groups from the E-amino groups of lysine residues at the N-terminus of a histone. Unless otherwise indicated by context, the term "histone" is meant to refer to any histone protein, including H1, H2A, H2B, H3, H4, and H5, from any species. Human HDAC proteins or gene products, include, but are not limited to, HDAC-1, HDAC-2, HDAC-3, HDAC-4, HDAC-5, HDAC-6, HDAC-7, HDAC-8, HDAC-9, HDAC-10 and HDAC-11. The histone deacetylase can also be derived from a protozoal or fungal source.

Any histone deacetylase inhibitor can be used in the context of the present invention. Histone deacetylase inhibitors from various chemical classes have been described, with four most important classes, namely (i) hydroxamic acid analogs, (ii) benzamide analogs, (iii) cyclic peptides (generally tetrapeptides)/peptolides and (iv) fatty acid analogs. Histone deacetylase inhibitors differ in their specificities towards the various histone deacetylases. These enzymes are divided into four main classes according to their sequence homology and expression patterns. Histone deacetylase inhibitors differ in their specificities towards the four main classes of histone deacetylases. These enzymes are divided into four classes according to their sequence homology and expression patterns. Generally hydroxamic acid analogs are effective on classes I, II, IV enzymes, benzamide analogs on class I and some also on classes II, III and/or IV, cyclic peptides/peptolides on class I and fatty acid analogs on classes I and IL. Brief overviews on histone deacetylase inhibitors have recently been given by Smith and Workman (International Journal of Biochemistry & Cell Biology (2008) doi:10.1016/j.biocel.2008.09.008) and, in a broader context, by Szyf (Annu. Rev. Pharmacol. Toxicol. (2009) 49, 243-263).

Suitable examples of a histone deacetylase inhibitor for use in the methods described herein include, but are not limited to, trichostatin A (TSA), N'-hydroxy-N-phenyl-octanediamide (suberoylanilide hydroxamic acid, SAHA), pyroxamide, M-carboxycinnamic acid bishydroxamide (CBHA), trichostatin C, salicylihydroxamic acid (SBHA), azelaic bishydroxamic acid (ABHA), azelaic-1-hydroxamate-9-anilide (AAHA), 6-(3-chlorophenylureido) carpoic hydroxamic acid (3Cl-UCHA), oxamflatin, A-161906, scriptaid, PXD-101, LAQ-824, cyclic hydroxamic acid-containing peptide (CHAP), ITF-2357, MW2796, MW2996, trapoxin A, FR901228 (FK 228 or Depsipeptide), FR225497, apicidin, CHAP, HC-toxin, WF27082, chlamydocin, sodium butyrate, isovalerate, valerate, 4-phenylbutyrate (4-PBA), 4-phenylbutyrate sodium (PBS), arginine butyrate, propionate, butyramide, isobutyramide, phenylacetate, 3-bromopropionate, tributyrin, valproic acid, valproate, CI-994, MS-27-275 (MS-275 or SNDX-275), 3'-amino derivative of MS-27-275, MGCD0103 or Depudecin, and SNDX-275. A number of histone deacetylase inhibitors are currently being clinically tested and SAHA (VORINOSTAT™) has recently been approved by the FDA for treatment of cutaneous T cell lymphoma.

In some embodiments of the methods and assays described herein, if a cancer is classified as having a poor prognosis or being a malignant cancer, at least one glygolytic or metabolic inhibitor is administered to the subject. In some such embodiments, the at least one glycolysis inhibitor is an siRNA or antisense RNA agent.

The terms "metabolic inhibitor," "glycolysis inhibitor" or "glycolytic inhibitor," as used herein, relates to a compound or an agent which targets, decreases, stops, or inhibits one or more components of the glycolytic or glycolysis pathway. Glycolysis refers to the metabolic pathway that converts glucose C6H12O6, into pyruvate, CH3COCOO—+H+. The free energy released in this process is used to form the high-energy compounds ATP (adenosine triphosphate) and NADH (reduced nicotinamide adenine dinucleotide). Glycolysis involves a sequence of ten reactions involving ten intermediate compounds (one of the steps involves two intermediates). The intermediates provide entry points to glycolysis. For example, most monosaccharides, such as fructose, glucose, and galactose, can be converted to one of these intermediates. The intermediates can also be directly useful. For example, the intermediate dihydroxyacetone phosphate (DHAP) is a source of the glycerol that combines with fatty acids to form fat.

The most common type of glycolysis is the Embden-Meyerhof-Parnas pathway (EMP pathway). Glycolysis also refers to other pathways, such as the Entner-Doudoroff pathway and various heterofermentative and homofermentative pathways. Suitable examples of a glycolysis inhibitor for use in the methods described herein include, but are not limited to, 3-bromo-pyruvic acid (bromoethylpyrruvate), Hypoglycin A, 2-deoxy-D-glucose, dichloro-acetate, oxamate and other pyruvate analogs, staurosporine, oligomycin, 6-dichloro-1,6-dideoxy-2-deoxyglucose, 2-[N-(7-nitrobenz-2-oxa-1,3-diaxol-4-yl)amino]-2-deoxyglucose (2-NBDG), 2-fluor-2-deoxy-D-glucose (2FG), 2-deoxy-D-galactose, 3H-2-deoxyglucose or analogs thereof. In addition, examples of 2-deoxyglucose compounds useful in the methods described herein include, but are not limited to, 2-deoxy-D-glucose, 2-deoxy-L-glucose; 2-bromo-D-glucose, 2-fluoro-D-glucose, 2-iodo-D-glucose, 6-fluoro-D-glucose, 6-thio-D-glucose, 7-glucosyl fluoride, 3-fluoro-D-glucose, 4-fluoro-D-glucose, 1-O-propyl ester of 2-deoxy-D-glucose, 1-O-tridecyl ester of 2-deoxy-D-glucose, 1-O-pentadecyl ester of 2-deoxy-D-glucose, 3-O-propyl ester of 2-deoxy-D-glucose, 3-O-tridecyl ester of 2-deoxy-D-glucose, 3-O-pentadecyl ester of 2-deoxy-D-glucose, 4-O-propyl ester of 2-deoxy-D-glucose, 4-O-tridecyl ester of 2-deoxy-D-glucose, 4-O-pentadecyl ester of 2-deoxy-D-glucose, 6-O-propyl ester of 2-deoxy-D-glucose, 6-O-tridecyl ester of 2-deoxy-D-glucose, 6-O-pentadecyl ester of 2-deoxy-D-glucose, and 5-thio-D-glucose, and mixtures thereof.

In some aspects, provided herein are methods for treating cancer comprising the step of administering to a subject diagnosed as having the tumor, using, for example, the diagnostic and prognostic methods and systems described herein, at least one proteosome inhibitor in a pharmaceutically acceptable carrier. In other aspects, provided herein are methods for treating a tumor comprising the step of administering to a subject diagnosed as having the tumor at least one histone deactylase inhibitor in a pharmaceutically acceptable carrier. In another aspect, provided herein is a method for treating a tumor comprising the step of administering to a subject diagnosed as having the tumor, using, for example, the diagnostic and prognostic methods and systems described herein, at least one glycolytic inhibitor in a pharmaceutically acceptable carrier. In some embodiments of these aspects and all such aspects described herein, the diagnosis of the tumor in the subject was performed according to determination of the TGS signature using the methods, systems, and kits described herein.

In other aspects, provided herein are methods for treating a basal-like breast tumor comprising the step of administering to a subject diagnosed as having the basal-like breast tumor, using, for example, the diagnostic and prognostic methods and systems described herein, at least one proteosome inhibitor in a pharmaceutically acceptable carrier. In some aspects, provided herein are methods for treating a basal-like breast tumor comprising the step of administering to a subject diagnosed as having the basal-like breast tumor, using, for example, the diagnostic and prognostic methods and systems described herein, at least one histone deactylase inhibitor in a pharmaceutically acceptable carrier. In other aspects, provided herein are method for treating a basal-like breast tumor comprising the step of administering to a subject diagnosed as having the basal-like breast tumor, using, for example, the diagnostic and prognostic methods and systems described herein, at least one glycolytic inhibitor in a pharmaceutically acceptable carrier.

The "agents" and "inhibitors" used in the therapeutic methods described herein can be selected from a group of a chemical, small molecule, chemical entity, nucleic acid sequences, nucleic acid analogues or protein or polypeptide or analogue of fragment thereof specific for one or more a malignancy associated response signature biomarkers or genes encoding a malignancy associated response signature biomarker. Nucleic acid sequences include, for example, but not limited to, nucleic acid sequence encoding proteins that act as repressors in the various target pathways described herein, antisense molecules, ribozymes, small inhibitory nucleic acid sequences, for example but not limited to RNAi, shRNAi, siRNA, micro RNAi (mRNAi), antisense oligonucleotides etc., specific for or directed against one or more genes encoding a malignancy associated response signature biomarker, such as for example, one or more of SEQ ID NOs: 1-4, 6, 7, 13, 14, 23, 29, 33-35, 37, 38, 66, 72, 77, 78, 84, 91, 93; one or more of SEQ ID NOs: 1, 2, 4, 7, 29, 33, 34, and 38; or SEQ ID NO: 134, for example. One of skill in the art, knowing the sequence a desired malignancy associated response signature biomarker to target, can design suitable inhibitory nucleic acid sequences using techniques known in the art or obtain ones from a commercial vendor, as described herein.

A protein and/or peptide agent or fragment thereof, can be any protein of interest, for example, but not limited to; mutated proteins; therapeutic proteins; truncated proteins, wherein the protein is normally absent or expressed at lower levels in the cell. Proteins of interest can be selected from a group comprising; mutated proteins, genetically engineered proteins, peptides, synthetic peptides, recombinant proteins, chimeric proteins, antibodies, humanized proteins, humanized antibodies, chimeric antibodies, modified proteins and fragments thereof. A therapeutic agent also includes any chemical, entity or moiety, including without limitation synthetic and naturally-occurring non-proteinaceous entities. In certain embodiments, the agent is a small molecule having a chemical moiety. Such chemical moieties can include, for example, unsubstituted or substituted alkyl, aromatic, or heterocyclyl moieties and typically include at least an amine, carbonyl, hydroxyl or carboxyl group, frequently at least two of the functional chemical groups, including macrolides, leptomycins and related natural products or analogues thereof. Therapeutic agents can be known to have a desired activity and/or property, or can be selected from a library of diverse compounds.

As used herein, the term "small molecule" refers to a chemical agent which can include, but is not limited to, a peptide, a peptidomimetic, an amino acid, an amino acid analog, a polynucleotide, a polynucleotide analog, an aptamer, a nucleotide, a nucleotide analog, an organic or inorganic compound (e.g., including heterorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

The term "inhibitor" refers to an agent that inhibits expression of a polypeptide or polynucleotide, or binds to, partially or totally blocks stimulation, decreases, prevents, delays activation, inactivates, desensitizes, or down regulates the activity of the polypeptide or the polynucleotide. Inhibitors are agents that, e.g., inhibit expression, e.g., translation, post-translational processing, stability, degradation, or nuclear or cytoplasmic localization of a polypeptide, or transcription, post transcriptional processing, stability or degradation of a polynucleotide or bind to, partially or totally block stimulation, DNA binding, transcription factor activity or enzymatic activity, decrease, prevent, delay activation, inactivate, desensitize, or down regulate the activity of a polypeptide or polynucleotide. An inhibitor can act directly or indirectly. Inhibition is achieved when the activity value of a polypeptide or polynucleotide is about at least 10% less, at least 20% less, at least 30% less, at least 40% less, at least 50% less, at least 60% less, at least 70% less, at least 80% less, at least 90% less, or absent or undetectable in comparison to a reference or control level in the absence of the inhibitor.

Accordingly, in some embodiments, an inhibitor for use in the therapeutic methods described herein is an siRNA agent, an antisense RNA agent, a small molecule agent, an antibody or antigen-binding fragment thereof specific for or directed against one or more malignancy associated response signature biomarkers of Table 3 (SEQ ID NOs: 1-154). In some such embodiments, the malignancy associated response signature biomarker is a proteasomal pathway biomarker, a histone descetylase pathway biomarker, a glycolysis pathway biomarker, or any combination thereof. In some embodiments, an inhibitor for use in the therapeutic methods described herein is an siRNA agent, an antisense RNA agent, a small molecule agent, an antibody or antigen-binding fragment thereof specific for or directed against one or more of SEQ ID NOs: 1-4, 6, 7, 13, 14, 23, 29, 33-35, 37, 38, 66, 72, 77, 78, 84, 91, 93. In some embodiments, an inhibitor for use in the therapeutic methods described herein is an siRNA agent, an antisense RNA agent, a small molecule agent, an antibody or antigen-binding fragment thereof specific for or directed against one or more of SEQ ID NOs: 1, 2, 4, 7, 29, 33, 34, and 38. In some embodiments, an inhibitor for use in the therapeutic methods described herein is an siRNA agent, an antisense RNA agent, a small molecule agent, an antibody or antigen-binding fragment thereof specific for or directed against SEQ ID NO: 134, Therapeutic compositions comprising inhibitors, such as small molecules, drugs, siRNA or antisense RNA agents, of malignancy associated response signature biomarkers useful for practicing the therapeutic methods described herein comprise a physiologically tolerable carrier together with an active compound, such as a proteosome inhibitor, histone deacetylase inhibitor, or glycolytic inhibitor, as described herein, dissolved or dispersed therein as an active ingredient. In a preferred embodiment, the therapeutic composition is not immunogenic when administered to a mammal or human patient for therapeutic purposes, unless so desired. As used herein, the terms "pharmaceutically acceptable", "physiologically tolerable" and grammatical variations thereof, as they refer to compositions, carriers, diluents and reagents, are used interchangeably and represent that the materials are capable of administration to or upon a mammal without the production of undesirable or unacceptable physiological effects such as toxicity, nausea, dizziness, gastric upset, immune reaction and the like. A pharmaceutically acceptable carrier will not promote the raising of an immune response to an agent with which it is admixed, unless so desired.

The preparation of a pharmacological composition that contains active ingredients dissolved or dispersed therein is well understood in the art and need not be limited based on formulation. Typically such compositions are prepared as injectable either as liquid solutions or suspensions, however, solid forms suitable for solution, or suspensions, in liquid prior to use can also be prepared. The preparation can also be emulsified or presented as a liposome composition. The active ingredient can be mixed with excipients which are pharmaceutically acceptable and compatible with the active ingredient and in amounts suitable for use in the therapeutic methods described herein. Suitable excipients are, for example, water, saline, dextrose, glycerol, ethanol or the like and combinations thereof. In addition, if desired, the composition can contain minor amounts of auxiliary substances such as wetting or emulsifying agents, pH buffering agents and the like which enhance the effectiveness of the active ingredient. Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Saline-based carriers are most useful for the administration of cells or cell preparations. Still further, aqueous carriers can contain more than one buffer salt, as well as salts such as sodium and potassium chlorides, dextrose, polyethylene glycol and other solutes.

Dosage and administration of the therapeutic compositions comprising, for example, inhibitor agents that specifically inhibit one or more of SEQ ID NOs: 1-4, 6, 7, 13, 14, 23, 29, 33-35, 37, 38, 66, 72, 77, 78, 84, 91, 93, described herein vary with the subject to be treated and the therapeutic approach taken in a given instance. The success of a treatment can be evaluated by the ordinarily skilled clinician by monitoring one or more symptoms or markers of the breast cancer being treated. Effective treatment includes any statistically significant improvement in one or more indicia of the disease. Where appropriate, a clinically accepted grade or scaling system for the given disease or disorder can be applied, with an improvement in the scale or grade being indicative of effective treatment. Depending upon the therapeutic composition, various subject parameters, and the mode of delivery, effective dosages can include, for example, 1 ng/kg of body weight up to a gram or more per kg of body weight and any amount in between. Preferred amounts can be, for example, in the range of 5 µg/kg body weight to 500 mg/kg of body weight or any amount in between. Dosages in such ranges can be administered once, twice, three times, four times or more per day, or every two days, every three days, every four days, once a week, twice a month, once a month or less frequently over a duration of days, weeks or months, depending on the breast cancer being treated, and as determined by a clinician. Sustained release formulations of the therapeutic compositions targeting one or more TGS biomarkers are specifically contemplated herein. Continuous, relatively low doses are also contemplated after an initial higher therapeutic dose.

The compositions are administered in a manner compatible with the dosage formulation, and in a therapeutically effective amount. The quantity to be administered and timing depends on the subject to be treated, capacity of the subject's system to utilize the active ingredient, and degree of therapeutic effect desired. Exemplary modes of administration of the therapeutic compositions described herein, include, but are not limited to, injection, infusion, inhalation (e.g., intranasal or intratracheal), ingestion, rectal, and topical (including buccal and sublingual) administration. The phrases "parenteral administration" and "administered parenterally" as used herein, refer to modes of administration other than enteral and topical administration, usually by injection. As used herein, "injection" includes, without limitation, intravenous, intramuscular, intraarterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. The phrases "systemic administration," "administered systemically", "peripheral administration" and "administered peripherally" as used herein refer to administration of a therapeutic composition other than directly into a target site, tissue, or organ, such as the lung, such that it enters the subject's circulatory system and, thus, is subject to metabolism and other like processes.

Systems

Also provided herein, in other aspects and embodiments are systems (and computer readable media for causing computer systems) to perform methods for classifying, determining or diagnosing the type of a cancer or tumor, such as a breast tumor from a patient, or providing a prognosis to a cancer patient.

Accordingly, in some aspects, provided herein are systems for classifying, determining or diagnosing the type of a cancer or tumor, such as a breast tumor from a patient, or providing a prognosis to a tumor patient. Such systems comprise: (a) a determination module configured to receive a biological sample, measure expression levels in the biological sample of at least 2 of the 154 biomarkers of the triple negative breast cancer gene signature biomarker genes provided in Table 3 (SEQ ID NOs: 1-154), and to output information of the expression levels of the at least 2 of the 154 biomarkers of the triple negative breast cancer gene signature biomarker genes in the biological sample; (b) a storage device configured to store the output information of the expression levels of the at least 2 of the 154 biomarkers of the triple negative breast cancer gene signature biomarker genes from the determination module; (c) a comparison module adapted to receive input from the storage device and compare the data stored on the storage device with reference expression level data of each of the at least 2 of the 154 biomarkers of the triple negative breast cancer gene signature biomarker genes, wherein if the expression level data of the at least 2 of the 154 biomarkers of the triple negative breast cancer gene signature biomarker genes in the biological sample is increased relative to the reference expression level data, the comparison module provides information to an output module that the biological sample is associated with a subject that has an epithelial progenitor cell tumor, a poor prognosis tumor or a highly malignant tumor, or a subject having a poor prognosis of breast cancer; and (d) an output module for displaying the information to the user.

Embodiments of the systems provided herein can be described through functional modules, which are defined by computer executable instructions recorded on computer readable media and which cause a computer to perform method steps when executed. The modules described herein are segregated by function for the sake of clarity. However, it should be understood that the modules/systems need not correspond to discreet blocks of code and the described functions can be carried out by the execution of various code portions stored on various media and executed at various times. Furthermore, it should be appreciated that the modules can perform other functions, thus the modules are not limited to having any particular functions or set of functions.

The computer readable storage media can be any available tangible media that can be accessed by a computer. Computer readable storage media includes volatile and nonvolatile, removable and non-removable tangible media implemented in any method or technology for storage of information such as computer readable instructions, data structures, program modules or other data. Computer readable storage media includes, but is not limited to, RAM (random access memory), ROM (read only memory), EPROM (erasable programmable read only memory), EEPROM (electrically erasable programmable read only memory), USB memory, flash memory or other memory technology, CD-ROM (compact disc read only memory), DVDs (digital versatile disks) or other optical storage media, magnetic cassettes, magnetic tape, magnetic disk storage or other magnetic storage media, cloud server memory systems, other types of volatile and non-volatile memory, and any other tangible medium which can be used to store the desired information and which can accessed by a computer including and any suitable combination of the foregoing.

Computer-readable data embodied on one or more computer-readable storage media can define instructions, for example, as part of one or more programs, that as a result of being executed by a computer, instruct the computer to perform one or more of the functions described herein, and/or various embodiments, variations and combinations thereof. Such instructions can be written in any of a plurality of programming languages, for example, Java, J#, Visual Basic, C, C#, C++, Fortran, Pascal, Eiffel, Basic, COBOL assembly language, and the like, or any of a variety of combinations thereof. The computer-readable storage media on which such instructions are embodied can reside on one or more of the components of either of a system, or a computer readable storage medium described herein, or can be distributed across one or more of such components.

The computer-readable storage media can be transportable such that the instructions stored thereon can be loaded onto any computer resource to implement the aspects of the present invention discussed herein. In addition, it should be appreciated that the instructions stored on the computer-readable medium, described above, are not limited to instructions embodied as part of an application program running on a host computer. Rather, the instructions can be embodied as any type of computer code (e.g., software or microcode) that can be employed to program a computer to implement aspects of the present invention. The computer executable instructions can be written in a suitable computer language or combination of several languages. Basic computational biology methods are known to those of ordinary skill in the art and are described in, for example, Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., 2nd ed., 2001).

The functional modules of certain embodiments of the systems described herein include, at minimum, a determination module or device, a storage module or device, a comparison module or device, and an output module or device or display module or device. The functional modules can be executed on one, or multiple, computers, or by using one, or multiple, computer networks. The determination system has computer executable instructions to provide e.g., expression information in computer readable form.

The determination system can comprise any system for determining or assaying expression levels of two or more genes of SEQ ID NOs.: 1-154. Such systems can include, but are not limited to, PCR or quantitative PCR machines or devices, microarray devices or systems, Northern blot analysis systems, ELISA etc., as known to one of ordinary skill in the art.

The information determined in the determination system can be read by the storage device. As used herein the "storage device" is intended to include any suitable computing or processing apparatus or other device configured or adapted for storing data or information. Examples of an electronic apparatus suitable for use with the present invention include a stand-alone computing apparatus, data telecommunications networks, including local area networks (LAN), wide area networks (WAN), Internet, Intranet, and Extranet, local and remote servers, and local and distributed computer processing systems. Storage devices also include, but are not limited to: magnetic storage media, such as floppy discs, hard disc storage media, remote or local servers, magnetic tape, optical storage media such as CD-ROM, DVD, electronic storage media such as RAM, ROM, EPROM, EEPROM and the like, general hard disks and hybrids of these categories such as magnetic/optical storage media. The storage device is adapted or configured for having recorded thereon nucleic acid sequence information. Such information can be provided in digital form that can be transmitted and read electronically, e.g., via the Internet, on diskette, via USB (universal serial bus) or via any other suitable mode of communication.

As used herein, "stored" refers to a process for encoding information on the storage device. Those skilled in the art can readily adopt any of the presently known methods for recording information on known media to generate manufactures comprising information relating to immune stimulating microbes.

In some embodiments of the aspects and embodiments described herein, the reference data stored in the storage device to be read by the comparison module is e.g., expression data of two or more genes of Table 3 (SEQ ID NOs: 1-154) obtained from a patient sample, such as a patient having a triple-negative breast cancer.

The "comparison module" can use a variety of available software programs and formats for the comparison operative to compare expression information data of the two or more TGS genes or biomarkers of Table 3(SEQ ID NOs: 1-154) determined in the determination system to one or more reference samples and/or stored reference data. In some embodiments of the systems described herein, the comparison module is configured to use pattern recognition techniques to compare information from one or more entries to one or more reference data patterns. The comparison module can be configured using existing commercially-available or freely-available software for comparing patterns, and can be optimized for particular data comparisons that are conducted. The comparison module provides computer readable information related to the expression levels of two or more of the TGS genes of Table 3 (SEQ ID NOs: 1-154).

The comparison module, or any other module of the invention, can include an operating system (e.g., UNIX) on which runs a relational database management system, a World Wide Web application, and a World Wide Web server.

World Wide Web application includes the executable code necessary for generation of database language statements (e.g., Structured Query Language (SQL) statements). Generally, the executables will include embedded SQL statements. In addition, the World Wide Web application can include a configuration file which contains pointers and addresses to the various software entities that comprise the server as well as the various external and internal databases which must be accessed to service user requests. The Configuration file also directs requests for server resources to the appropriate hardware—as may be necessary should the server be distributed over two or more separate computers. In one embodiment, the World Wide Web server supports a TCP/IP protocol. Local networks such as this are sometimes referred to as "Intranets." An advantage of such Intranets is that they allow easy communication with public domain databases residing on the World Wide Web (e.g., the GenBank or Swiss Pro World Wide Web site). Thus, in some embodiments, users can directly access data (via Hypertext links for example) residing on Internet databases using a HTML interface provided by Web browsers and Web servers.

The comparison module provides a computer readable comparison result that can be processed in computer readable form by predefined criteria, or criteria defined by a user, to provide a content based in part on the comparison result that may be stored and output as requested by a user using a display module or output device.

The content based on the comparison result, can be, for example, the type of tumor, or the prognosis of the tumor. Alternatively, or additionally, the content based on the comparison result can be a further treatment step indicated for the patient, e.g., administration of a proteasome inhibitor or histone deacetylase inhibitor.

In some embodiments of the systems described herein, the content based on the comparison result is displayed on a computer monitor. In some embodiments of the systems described herein, the content based on the comparison result is displayed through printable media. The display module can be any suitable device configured to receive from a computer and display computer readable information to a user. Non-limiting examples include, for example, general-purpose computers such as those based on Intel PENTIUM-type processor, Motorola PowerPC, Sun UltraSPARC, Hewlett-Packard PA-RISC processors, any of a variety of processors available from Advanced Micro Devices (AMD) of Sunnyvale, Calif., tablet or mobile phone devices, or any other type of processor, visual display devices such as flat panel displays, cathode ray tubes and the like, as well as computer printers of various types.

In some embodiments of the systems described herein, a World Wide Web browser is used for providing a user interface for display of the content based on the comparison result. It should be understood that other modules of the invention can be adapted to have a web browser interface. Through the Web browser, a user may construct requests for retrieving data from the comparison module. Thus, the user will typically point and click to user interface elements such as buttons, pull down menus, scroll bars and the like conventionally employed in graphical user interfaces.

The modules of the machine, or those used in the computer readable medium, can assume numerous configurations. For example, function may be provided on a single machine or distributed over multiple machines.

Accordingly, the methods described herein therefore provide for systems (and computer readable media for causing computer systems) to perform methods for determining or diagnosing the type of a cancer or tumor in a patient, such as a breast tumor from a patient, or providing a prognosis to a tumor patient.

Systems and computer readable media described herein are merely illustrative embodiments of the invention for performing methods of diagnosis in an individual, and are not intended to limit the scope of the invention. Variations of the systems and computer readable media described herein are possible and are intended to fall within the scope of the invention.

Kits for Detection of Malignancy Associated Response Signature Biomarkers

Conveniently, in some aspects, expression of malignancy associated response signature biomarkers in the methods described herein can be evaluated using a kit comprising at least one malignancy associated response signature biomarker probe suitable for detecting one or more malignancy associated response signature biomarkers. As used herein, a "malignancy associated response signature probe" can include any molecule capable of detecting a malignancy associated response signature biomarker including, but not limited to, monoclonal and polyclonal antibodies and fragments thereof, and oligonucleotides. For example, the kit can comprise an antibody specific for an epitope of a malignancy associated response signature biomarker protein encoded by an malignancy associated response signature biomarker gene, an oligonucleotide probe complementary to at least a portion of a malignancy associated response signature biomarker gene or to at least a portion an RNA (e.g., mRNA) encoded by a malignancy associated response signature biomarker gene, or primer pairs suitable for evaluating gene expression of a malignancy associated response signature biomarker by a polymerase chain reaction (PCR)-based method, such as real time PCR or reverse transcription PCR. Other methodologies for measuring expression of a malignancy associated response signature biomarker include ribonuclease protection assays, 51 nuclease assays, and Northern blot analyses. Optionally, the kits include instructions for detecting malignancy associated response signature biomarker detection or for performing the methods or diagnosis and prognosis described herein In some embodiments, the kit can comprise a microarray that can be used to determine expression of at least one malignancy associated response signature biomarker in a tumor sample and instructions for analyzing the information for use in the methods described herein. The microarray includes at least one oligonucleotide comprising a sequence of at least one of the malignancy associated response signature biomarker from the group of markers listed in Table 3 (SEQ ID NOs: 1-154). More preferably, the microarray includes oligonucleotides comprising a sequence of at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 23, at least 25, at least 30, at least 35, at least 40, at least 45, at least 50, at least 100, at least 150, or all 154 of the 154 malignancy associated response signature biomarkers described in Table 3 (SEQ ID NOs: 1-154). The term "microarray," as used herein, refers to an ordered arrangement of hybridizable array elements, e.g. oligonucleotide probes, on a substrate, e.g. glass slide or silica. Suitably, the microarray comprises control probes to allow for detection of expression levels that can be used to determine enrichment of malignancy associated response signature biomarker genes relative to a control or reference sample.

Screening Methods

The malignancy associated response signature biomarkers described herein are also useful in screening and identifying novel therapeutic agents against malignant and poor prognosis breast cancers, such as basal-like breast tumors.

Accordingly, in one aspect, provided herein is a method of identifying a candidate therapeutic agent against a tumor, such as a basal-like breast tumor, the method comprising the steps of (a) exposing a BPLER cell culture to a test agent, wherein said BPLER cell culture comprises human breast primary epithelial cells (BPE) transformed with a defined set of genetic elements (BPLER cells); (b) measuring the expression of at least 10 of the 154 of the genes of a malignancy associated response signature in the culture, wherein the malignancy associated response signature comprises an expression pattern of a set of 10-154 biomarkers set forth in Table 3 (SEQ ID NOs: 1-154); (c) comparing the expression of the same at least 10 genes of malignancy associated response signature as was measured in step (b) to an expression signature reference from a BPLER cell culture that has not been exposed to the test agent, wherein a decrease in expression of at least 5 of the at least 10 genes in the test culture compared to the expression signature of the reference culture indicates that the test agent is a candidate therapeutic agent against the tumor, e.g., basal-like breast tumor.

The term "screening" as used herein refers to the use of cells and tissues in the laboratory to identify agents with a specific function, e.g., inhibiting activity against a malignancy associated response signature biomarker. "High-throughput screening technologies" refer to platforms and assays used to rapidly test thousands of test compounds. For example, reporter systems used in cell lines can be used to assess whether compounds activate or inhibit particular signaling pathways of interest, such as the ubiquitin-proteasome pathway.

The "candidate agent" used in the screening methods described herein can be selected from a group of a chemical, small molecule, chemical entity, nucleic acid sequences, an action; nucleic acid analogues or protein or polypeptide or analogue of fragment thereof. Nucleic acid sequences include, for example, but not limited to, nucleic acid sequence encoding proteins that act as transcriptional repressors, antisense molecules, ribozymes, small inhibitory nucleic acid sequences, for example but not limited to RNAi, shRNAi, siRNA, micro RNAi (mRNAi), antisense oligonucleotides etc. A protein and/or peptide agent or fragment thereof, can be any protein of interest, for example, but not limited to; mutated proteins; therapeutic proteins; truncated proteins, wherein the protein is normally absent or expressed at lower levels in the cell. Proteins of interest can be selected from a group comprising; mutated proteins, genetically engineered proteins, peptides, synthetic peptides, recombinant proteins, chimeric proteins, antibodies, humanized proteins, humanized antibodies, chimeric antibodies, modified proteins and fragments thereof. A candidate agent also includes any chemical, entity or moiety, including without limitation synthetic and naturally-occurring non-proteinaceous entities. In certain embodiments, the candidate agent is a small molecule having a chemical moiety. Such chemical moieties can include, for example, unsubstituted or substituted alkyl, aromatic, or heterocyclyl moieties and typically include at least an amine, carbonyl, hydroxyl or carboxyl group, frequently at least two of the functional chemical groups, including macrolides, leptomycins and related natural products or analogues thereof. Candidate agents can be known to have a desired activity and/or property, or can be selected from a library of diverse compounds.

As used herein, the term "small molecule" refers to a chemical agent which can include, but is not limited to, a peptide, a peptidomimetic, an amino acid, an amino acid analog, a polynucleotide, a polynucleotide analog, an aptamer, a nucleotide, a nucleotide analog, an organic or inorganic compound (e.g., including heterorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

The term "inhibitor" refers to an agent that inhibits expression of a polypeptide or polynucleotide, or binds to, partially or totally blocks stimulation, decreases, prevents, delays activation, inactivates, desensitizes, or down regulates the activity of the polypeptide or the polynucleotide. Inhibitors are agents that, e.g., inhibit expression, e.g., translation, post-translational processing, stability, degradation, or nuclear or cytoplasmic localization of a polypeptide, or transcription, post transcriptional processing, stability or degradation of a polynucleotide or bind to, partially or totally block stimulation, DNA binding, transcription factor activity or enzymatic activity, decrease, prevent, delay activation, inactivate, desensitize, or down regulate the activity of a polypeptide or polynucleotide. An inhibitor can act directly or indirectly. Inhibition is achieved when the activity value of a polypeptide or polynucleotide is about at least 10% less, at least 20% less, at least 30% less, at least 40% less, at least 50% less, at least 60% less, at least 70% less, at least 80% less, at least 90% less, or absent or undetectable in comparison to a reference or control level in the absence of the inhibitor.

Also included as candidate agents are pharmacologically active drugs, genetically active molecules, etc. Such candidate agents of interest include, for example, chemotherapeutic agents, hormones or hormone antagonists, growth factors or recombinant growth factors and fragments and variants thereof. Exemplary of pharmaceutical agents suitable for use with the screening methods described herein are those described in, "The Pharmacological Basis of Therapeutics," Goodman and Gilman, McGraw-Hill, New York, N.Y., (1996), Ninth edition, under the sections: Water, Salts and Ions; Drugs Affecting Renal Function and Electrolyte Metabolism; Drugs Affecting Gastrointestinal Function; Chemotherapy of Microbial Diseases; Chemotherapy of Neoplastic Diseases; Drugs Acting on Blood-Forming organs; Hormones and Hormone Antagonists; Vitamins, Dermatology; and Toxicology, all of which are incorporated herein by reference in their entireties. Also included are toxins, and biological and chemical warfare agents, for example see Somani, S. M. (Ed.), "Chemical Warfare Agents," Academic Press, New York, 1992), the contents of which is herein incorporated in its entirety by reference.

Candidate agents, such as chemical compounds, can be obtained from a wide variety of sources including libraries of synthetic or natural compounds. For example, numerous means are available for random and directed synthesis of a wide variety of organic compounds, including biomolecules, including expression of randomized oligonucleotides and oligopeptides. Alternatively, libraries of natural compounds in the form of bacterial, fungal, plant and animal extracts are available or readily produced. Additionally, natural or synthetically produced libraries and compounds are readily modified through conventional chemical, physical and biochemical means, and may be used to produce combinatorial libraries. Known pharmacological agents can be subjected to directed or random chemical modifications, such as acylation, alkylation, esterification, amidification, etc. to produce structural analogs. Synthetic chemistry transformations and protecting group methodologies (protection and deprotection) useful in synthesizing the candidate compounds for use in the screening methods described herein are known in the art and include, for example, those such as described in R. Larock (1989) Comprehensive Organic Transformations, VCH Publishers; T. W. Greene and P. G. M. Wuts, Protective Groups in Organic Synthesis, 2nd ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof, the contents of each of which are herein incorporated in their entireties by reference.

Examples of methods for the synthesis of molecular libraries can be found in the art, for example in: DeWitt et al. (1993) Proc. Natl. Acad. Sci. U.S.A. 90:6909; Erb et al. (1994) Proc. Natl. Acad. Sci. USA 91:11422; Zuckermann et al. (1994) J. Med. Chem. 37:2678; Cho et al. (1993) Science 261:1303; Carrell et al. (1994) Angew. Chem. Int. Ed. Engl. 33:2059; Carell et al (1994) Angew. Chem. Int. Ed. Engl. 33:2061; and Gallop et al. (1994) J. Med. Chem. 37:1233, the contents of each of which are herein incorporated in their entireties by reference.

Libraries of candidate agents can be presented in solution (e.g., Houghten (1992), Biotechniques 13:412-421), or on beads (Lam (1991), Nature 354:82-84), chips (Fodor (1993) Nature 364:555-556), bacteria (Ladner, U.S. Pat. No. 5,223, 409), spores (Ladner U.S. Pat. No. 5,223,409), plasmids (Cull et al. (1992) Proc Natl Acad Sci USA 89:1865-1869) or on phage (Scott and Smith (1990) Science 249:386-390; Devlin (1990) Science 249:404-406; Cwirla et al. (1990) Proc. Natl. Acad. Sci. 87:6378-6382; Felici (1991) J. Mol. Biol. 222:301-310; Ladner supra.), the contents of each of which are herein incorporated in their entireties by reference.

High through-put screening is a process in which libraries of compounds are tested for a given activity. High throughput screening seeks to screen large numbers of compounds rapidly and in parallel. For example, using microtiter plates, robotic equipment, and automated assay equipment, a pharmaceutical company may perform as many as 100,000 assays per day in parallel.

The compound screening assays described herein can involve more than one measurement of an observable reporter function, expression or activity of a malignancy associated response biomarker gene. Multiple measurements allow for following the biological activity over incubation time with the test compound. In one embodiment, the expression or activity of a malignancy associated response biomarker gene is measured at a plurality of times to allow monitoring of the effects of the test compound at different incubation times.

Accordingly, in some embodiments of the screening aspects, provided herein is a high throughput automated screening system for identifying a candidate therapeutic agent against a tumor, such as a basal-like breast tumor, the system comprising:

a) a high throughput candidate agent screening culture, connected to b) a computer processor and a computer-readable physical medium with software instructions encoded thereupon for a process, executable by said processor, said instructions comprising:

(i) instructions for receiving data regarding the measurement of the expression of at least 10 of the 154 of the genes of a malignancy associated response in a high-throughput screening culture, wherein the malignancy associated response comprises an expression pattern of a set of 10-154 biomarkers set forth in Table 3 (SEQ ID NOs: 1-154); (ii) instructions for comparing the expression data received in (i) with reference signature expression data of the same at least 10 genes of malignancy associated response from a cell culture that has not been exposed to the test agents, wherein said comparing identifies whether there is a decrease in expression of at least 5 of the at least 10 genes in the test culture compared to the expression signature of the reference culture and thus indicates that the test agent is a candidate therapeutic agent against the tumor, such as basal-like breast tumor; and (iii) outputting the result of said comparison to a user interface.

The high-throughput screening and other system methods described herein be implemented using any device capable of implementing the methods. Examples of devices that can be used include but are not limited to electronic computational devices, including computers of all types. When the methods described herein are implemented in a computer, the computer program that can be used to configure the computer to carry out the steps of the methods can be contained in any computer readable medium capable of containing the computer program. Examples of computer readable medium that can be used include but are not limited to diskettes, CD-ROMs, DVDs, ROM, RAM, USB devices, and other memory and computer storage devices. The computer program that can be used to configure the computer to carry out the steps of the methods can also be provided over an electronic network, for example, over the internet, worldwide web, an intranet, or other network.

In one such example, the methods described herein can be implemented in a system comprising a processor and a computer readable medium that includes program code means for causing the system to carry out the steps of the methods described in the present invention. The processor can be any processor capable of carrying out the operations needed for implementation of the methods. The program code means can be any code that when implemented in the system can cause the system to carry out the steps of the methods described in the present invention. Examples of program code means include but are not limited to instructions to carry out the methods described in this patent written in a high level computer language such as C++, Java, or Fortran; instructions to carry out the methods described herein written in a low level computer language such as assembly language; or instructions to carry out the methods described herein in a computer executable form such as compiled and linked machine language.

Some aspects and embodiments disclosed herein can be illustrated by, for example any of the following numbered paragraphs:

1. A malignancy associated response signature for a cancer-initiating cell consisting essentially of an expression pattern of a set of biomarkers set forth in SEQ ID NOs: 1-4, 6, 7, 13, 14, 23, 29, 33-35, 37, 38, 66, 72, 77, 78, 84, 91, 93, and 151, wherein at least 5 of the 23 biomarkers have increased expression compared to a reference value.

2. The malignancy associated response signature of paragraph 1, wherein the cancer-initiating cell is a breast cancer-initiating cell.
3. The malignancy associated response signature of paragraph 1, wherein the cancer-initiating cell is a triple-negative breast cancer-initiating cell.
4. The malignancy associated response signature of paragraph 1, wherein the cancer-initiating cell is a Luminal B breast cancer-initiating cell
5. The malignancy associated response signature of paragraph 1, wherein the cancer-initiating cell is an epithelial breast cancer-initiating cell.
6. The malignancy associated response signature of any one of paragraphs 1-5, wherein the expression of the at least 5 of the 23 biomarkers is increased at least 1.8-fold compared to the reference value.
7. A malignancy associated response signature for a cancer-initiating cell comprising an expression pattern of a set of at least 10 biomarkers set forth in SEQ ID NOs: 1-154, wherein at least 10 of the 154 markers have increased expression compared to a reference value.
8. The malignancy associated response signature of paragraph 7, wherein the cancer-initiating cell is a breast cancer-initiating cell.
9. The malignancy associated response signature of paragraph 7, wherein the cancer-initiating cell is a triple-negative breast cancer-initiating cell.
10. The malignancy associated response signature of paragraph 7, wherein the cancer-initiating cell is a Luminal B breast cancer-initiating cell.
11. The malignancy associated response signature of paragraph 7, wherein the cancer-initiating cell is an epithelial breast cancer-initiating cell.
12. The malignancy associated response signature of any one of paragraphs 7-11, wherein the expression of the at least 5 biomarkers is increased at least 1.8-fold compared to the reference value.
13. The malignancy associated response signature of any one of paragraphs 7-12, wherein at least 2 of the set of at least 10 biomarkers set forth in SEQ ID NOs: 1-154 is selected from the group consisting of SEQ ID NOs: 1-4, 6, 7, 13, 14, 23, 29, 33-35, 37, 38, 66, 72, 77, 78, 84, 91, 93, and 151.
14. A malignancy associated response signature for a cancer-initiating cell susceptible to proteasomal gene inhibition comprising an expression pattern of a set of at least 3 biomarkers set forth in SEQ ID NOs: 1, 2, 4, 7, 15, 16, 21, 29, 33, 34, 38, 60, 74, 76, and 149, wherein at least 3 of the 15 biomarkers have increased expression compared to a reference value.
15. A malignancy associated response signature for a cancer-initiating cell susceptible to mitosis gene inhibition comprising an expression pattern of a set of at least 3 biomarkers set forth in SEQ ID NOs: 9, 17, 22, 23, 31, 37, 35, 52, 68, 80, 101, 124, 130, and 137, wherein at least 3 of the 14 biomarkers have increased expression compared to a reference value.
16. A malignancy associated response signature for a cancer-initiating cell susceptible to RNA splicing gene inhibition comprising an expression pattern of a set of at least 3 biomarkers set forth in SEQ ID NOs: 5, 10, 11, 18, 20, 26, 36, 41, 57, 61, 123, 127, and 151, wherein at least 3 of the 13 biomarkers have increased expression compared to a reference value.
17. A malignancy associated response signature for a cancer-initiating cell susceptible to molecular transport gene inhibition comprising an expression pattern of a set of at least 3 biomarkers set forth in SEQ ID NOs: 12, 13, 32, 48, 51, 56, 64, 91, 96, 98, 108, 121, and 147, wherein at least 3 of the 14 biomarkers have increased expression compared to a reference value.
18. A malignancy associated response signature for a cancer-initiating cell susceptible to metabolic gene inhibition comprising an expression pattern of a set of at least 3 biomarkers of SEQ ID NOs: 46, 49, 65, 69, 72, 78, 104, 107, 112, 126, 138, 141, and 153, wherein at least 3 of the 13 biomarkers have increased expression compared to a reference value.
19. The malignancy associated response signature of any one of paragraphs 14-18, wherein the cancer-initiating cell is a breast cancer-initiating cell.
20. The malignancy associated response signature of any one of paragraphs 14-18, wherein the cancer-initiating cell is a triple-negative breast cancer-initiating cell.
21. The malignancy associated response signature of any one of paragraphs 14-18, wherein the cancer-initiating cell is a Luminal B breast cancer-initiating cell.
22. The malignancy associated response signature of any one of paragraphs 14-18, wherein the cancer-initiating cell is an epithelial breast cancer-initiating cell.
23. The malignancy associated response signature of any one of paragraphs 14-22, wherein the expression of the at least 3 biomarkers is at least 1.8-fold increased compared to the reference value.
24. A method of classifying a cancer in a subject in need thereof, the method comprising:
    a. assaying expression of ten or more of the 154 malignancy associated response signature biomarkers of SEQ ID NOs: 1-154 in a biological sample obtained from the subject having a cancer, and
    b. comparing the expression of the ten or more of the 154 malignancy associated response signature biomarkers of SEQ ID NOs: 1-154 in the biological sample obtained from the subject having a cancer with a reference value, wherein increased expression of 1.8-fold or greater of at least ten of the biomarkers in the biological sample obtained from the subject relative to the reference value indicates that the cancer is classified as having a poor prognosis or being a malignant cancer, and absence of increased expression of 1.8-fold or greater of at least ten of the biomarkers relative to the reference value indicates that the cancer does not have poor prognosis or is not a malignant cancer.
25. The method of paragraph 24, wherein the cancer is a breast cancer.
26. The method of paragraph 24, wherein the cancer is a triple-negative breast cancer.
27. The method of paragraph 24, wherein the cancer is a Luminal B breast cancer.
28. The method of paragraph 24, wherein the cancer is an epithelial breast cancer.
29. The method of any one of paragraphs 27-31, wherein if the cancer is classified as having a poor prognosis or being a malignant cancer, the method further comprises the step of administering at least one proteasome inhibitor to the subject.
30. The method of any one of paragraphs 24-29, wherein if the cancer is classified as having a poor prognosis or being a malignant cancer and wherein if at least two of the ten or more genes having increased expression is a proteasomal malignancy associated response signature biomarker of SEQ ID NOs: 1, 2, 4, 7, 15, 16, 21, 29, 33, 34, 38, 60, 74, 76, and 149, the method further comprises the step of administering at least one proteasome inhibitor to the subject.
31. The method of any one of paragraphs 29 or 30, wherein the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.
32. The method of any one of paragraphs 29-31, wherein the at least one proteasome inhibitor specifically inhibits the malignancy associated response signature biomarker set forth in SEQ ID NOs: 134 (MCL-1).
33. The method of any one of paragraphs 29-32, wherein the at least one proteasome inhibitor is an siRNA or antisense RNA agent.
34. The method of any one of paragraphs 29-30, wherein the at least one proteasome inhibitor is bortezomib.
35. The method of any one of paragraphs 24-34, wherein if the cancer is classified as having a poor prognosis or being a malignant cancer, the method further comprises the step of administering at least one histone deacetylase inhibitor to the subject.
36. The method of paragraph 35, wherein the at least one histone deacetylase inhibitor is an siRNA or antisense RNA agent.
37. The method of paragraph 35, wherein the at least one histone deacetylase inhibitor is trichostatin A (TSA) or Vorinostat.
38. The method of any one of paragraphs 24-37, wherein if the cancer is classified as having a poor prognosis or being a malignant cancer, the method further comprises the step of administering at least one glygolytic inhibitor to the subject.
39. The method of paragraph 38, wherein the at least one glycolysis inhibitor is an siRNA or antisense RNA agent.
40. The method of any one of paragraphs 24-39, wherein if the cancer is classified as having a poor prognosis or being a malignant cancer, relative survival rate, relative risk of metastasis, treatment option, or any combination thereof is determined for the subject.
41. A method of classifying a cancer in a subject in need thereof, the method comprising:
 a. assaying expression of at least five biomarkers set forth in SEQ ID NOs: 1-4, 6, 7, 13, 14, 23, 29, 33-35, 37, 38, 66, 72, 77, 78, 84, 91, 93, and 151 in a biological sample obtained from the subject having a cancer, and
 b. comparing the expression of the five or more of the 23 malignancy associated response signature biomarkers in the biological sample obtained from the subject having a cancer with a reference value, wherein increased expression of 1.8-fold or greater of at least ten of the biomarkers in the biological sample obtained from the subject relative to the reference value indicates that the cancer is classified as having a poor prognosis or being a malignant cancer, and absence of increased expression of 1.8-fold or greater of at least ten of the biomarkers relative to the reference value indicates that the cancer does not have poor prognosis or is not a malignant cancer.
42. The method of paragraph 41, wherein the cancer is a breast cancer.
43. The method of paragraph 41, wherein the cancer is a triple-negative breast cancer.
44. The method of paragraph 41, wherein the cancer is a Luminal B breast cancer.
45. The method of paragraph 41, wherein the cancer is an epithelial breast cancer.
46. The method of any one of paragraphs 41-45, wherein if the cancer is classified as having a poor prognosis or being a malignant cancer, the method further comprises the step of administering at least one proteasome inhibitor to the subject.
47. The method of any one of paragraphs 41-45, wherein if the cancer is classified as having a poor prognosis or being a malignant cancer and wherein at least one of the five or more genes having increased expression is a proteasomal malignancy associated response signature biomarker of SEQ ID NOs: 1, 2, 4, 7, 29, 33, 34, and 38, the method further comprises the step of administering at least one proteasome inhibitor to the subject.
48. The method of any one of paragraphs 46-47, wherein the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.
49. The method of any one of paragraphs 46-47, wherein the at least one proteasome inhibitor specifically inhibits the malignancy associated response signature biomarker set forth in SEQ ID NOs: 134 (MCL-1).
50. The method of any one of paragraphs 46-49, wherein the at least one proteasome inhibitor is an siRNA or antisense RNA agent.
51. The method of any one of paragraphs 46-47, wherein the at least one proteasome inhibitor is bortezomib.
52. A method of classifying a cancer in a subject in need thereof, the method comprising:
 a. assaying expression of at least three malignancy associated response signature biomarkers set forth in SEQ ID NOs: 1, 2, 4, 7, 15, 16, 21, 29, 33, 34, 38, 60, 74, 76, and 149 in a biological sample obtained from the subject having a cancer, and
 b. comparing the expression of the at least three malignancy associated response signature biomarkers in the biological sample obtained from the subject having a cancer with a reference value, wherein increased expression of 1.8-fold or greater of at least three of the biomarkers in the biological sample obtained from the subject relative to the reference value indicates that the cancer is classified as having a poor prognosis or being a malignant cancer, and absence of increased expression of 1.8-fold or greater of at least three of the biomarkers relative to the reference value indicates that the cancer does not have poor prognosis or is not a malignant cancer.
53. The method of paragraph 52, wherein the cancer is a breast cancer.
54. The method of paragraph 52, wherein the cancer is a triple-negative breast cancer.
55. The method of paragraph 52, wherein the cancer is a Luminal B breast cancer.
56. The method of paragraph 52, wherein the cancer is an epithelial breast cancer.
57. The method of any one of paragraphs 52-56, wherein if the cancer is classified as having a poor prognosis or being a malignant cancer, the method further comprises the step of administering at least one proteasome inhibitor to the subject.
58. The method of paragraph 57, wherein the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.

59. The method of paragraph 57, wherein the at least one proteasome inhibitor specifically inhibits the malignancy associated response signature biomarker set forth in SEQ ID NOs: 134 (MCL-1).
60. The method of any one of paragraphs 57-59, wherein the at least one proteasome inhibitor is an siRNA or antisense RNA agent.
61. The method of paragraph 57, wherein the at least one proteasome inhibitor is bortezomib.
62. An assay comprising the steps of:
   a. measuring expression of ten or more of the 154 malignancy associated response signature biomarkers set forth in SEQ ID NOs: 1-154 in a biological sample obtained from a subject having cancer, and
   b. comparing the expression of the ten or more of the 154 malignancy associated response signature biomarkers set forth in SEQ ID NOs: 1-154 in the biological sample obtained from the subject having a cancer with a reference value, wherein increased expression of at least ten of the measured biomarkers in the biological sample obtained from the subject relative to the reference value diagnoses the patient as having a poor prognosis or malignant cancer, and absence of increased expression of at least ten of the measured biomarkers relative to the reference value diagnoses the patient as not having a poor prognosis or malignant cancer.
63. The assay of paragraph 62, wherein the increased expression of the ten or more of the 154 malignancy associated response signature biomarkers in the biological sample determines a prognosis for the subject having the cancer.
64. The assay of paragraph 63, wherein the prognosis comprises relative survival rate, relative risk of metastasis, treatment option, or any combination thereof.
65. The assay of any one of paragraphs 62-64, wherein the cancer is a breast cancer.
66. The assay of any one of paragraphs 62-64, wherein the cancer is a triple-negative breast cancer.
67. The assay of any one of paragraphs 62-64, wherein the cancer is a Luminal B breast cancer.
68. The assay of any one of paragraphs 62-64, wherein the cancer is an epithelial breast cancer.
69. The assay of any one of paragraphs 62-68, wherein if the subject is diagnosed as having a poor prognosis or malignant cancer, the subject is administered at least one proteasome inhibitor.
70. The assay of any one of paragraphs 62-68, wherein if the subject is diagnosed as having a poor prognosis or malignant cancer and wherein at least two of the ten or more genes having increased expression is a proteasomal malignancy associated response signature biomarker of SEQ ID NOs: 1, 2, 4, 7, 15, 16, 21, 29, 33, 34, 38, 60, 74, 76, and 149, the subject is administered at least one proteasome inhibitor.
71. The assay of any one of paragraphs 69-70, wherein the at least one proteasome inhibitor specifically inhibits any of the proteasomal malignancy associated response signature biomarkers set forth in SEQ ID NOs: 1, 2, 4, 7, 15, 16, 21, 29, 33, 34, 38, 60, 74, 76, and 149.
72. The assay of any one of paragraphs 69-71, wherein the at least one proteasome inhibitor specifically inhibits the malignancy associated response signature biomarker set forth in SEQ ID NOs: 134 (MCL-1).
73. The assay of any one of paragraphs 69-72, wherein the at least one proteasome inhibitor is an siRNA or antisense RNA agent.
74. The assay of any one of paragraphs 69-70, wherein the at least one proteasome inhibitor is bortezomib.
75. The assay of any one of paragraphs 69-74, wherein if the subject is diagnosed as having a poor prognosis or malignant cancer, the subject is administered at least one histone deacetylase inhibitor.
76. The assay of paragraph 75, wherein the at least one histone deacetylase inhibitor is an siRNA or antisense RNA agent.
77. The assay of paragraph 75, wherein the at least one histone deacetylase inhibitor is trichostatin A (TSA) or Vorinostat.
78. The assay of any one of paragraphs 69-77, wherein if the subject is diagnosed as having a poor prognosis or malignant cancer, the subject is administered at least one glygolytic inhibitor.
79. The assay of paragraph 78, wherein the at least one glycolysis inhibitor is an siRNA or antisense RNA agent.
80. An assay comprising the steps of:
   a. dividing a cell culture grown from a biopsy obtained from a subject having cancer into at least 5 separate cultures;
   b. exposing each of the at least 5 separate cultures to a different inhibitory agent, wherein each said different inhibitory agent specifically inhibits a different malignancy associated response signature biomarker set forth in SEQ ID NOs: 1-154
   c. growing each of the at least 5 separate cell cultures of step (b) for at least 12 hours;
   d. measuring viability of the cells from each of the cultures of step (c), wherein if the total viability of the cells in at least 60% of the cultures is decreased by at least 25%, then the biopsy obtained from the subject comprises cancer-initiating cells.
81. The assay of paragraph 80, wherein the inhibitory agents are selected from siRNA agents, antisense RNA agents, or small molecules, that specifically inhibit any of the cancer gene signature biomarkers set forth in SEQ ID NOs: 1-154.
82. The assay of any one of paragraphs 80-81, wherein the inhibitory agents specifically inhibit any of the malignancy associated response signature biomarkers set forth in SEQ ID NOs: 1-4, 6, 7, 13, 14, 23, 29, 33-35, 37, 38, 66, 72, 77, 78, 84, 91, 93, and 151.
83. The assay of any one of paragraphs 80-81, wherein at least one inhibitory agent specifically inhibits any of the malignancy associated response signature biomarkers set forth in SEQ ID NOs: 1-4, 6, 7, 13, 14, 23, 29, 33-35, 37, 38, 66, 72, 77, 78, 84, 91, 93, and 151.
84. The assay of any one of paragraphs 80-83, wherein at least one inhibitory agent specifically inhibits any of the proteasomal malignancy associated response signature biomarkers set forth in SEQ ID NOs: 1, 2, 4, 7, 15, 16, 21, 29, 33, 34, 38, 60, 74, 76, and 149.
85. The assay of any one of paragraphs 80-84, wherein at least one inhibitory agent specifically inhibits any of the mitosis cancer gene signature biomarkers set forth in SEQ ID NOs: 9, 17, 22, 23, 31, 37, 35, 52, 68, 80, 101, 124, 130, and 137.
86. The assay of any one of paragraphs 80-85, wherein at least one inhibitory agent specifically inhibits any of the RNA splicing malignancy associated response signature biomarkers set forth in SEQ ID NOs: 5, 10, 11, 18, 20, 26, 36, 41, 57, 61, 123, 127, and 151.
87. The assay of any one of paragraphs 80-86, wherein at least one inhibitory agent specifically inhibits any of the molecular transport malignancy associated response signature biomarkers set forth in SEQ ID NOs: 12, 13, 32, 48, 51, 56, 64, 91, 96, 98, 108, 121, and 147.
88. The assay of any one of paragraphs 80-87, wherein at least one inhibitory agent specifically inhibits any of the metabolic malignancy associated response signature biomarkers set forth in SEQ ID NOs: 46, 49, 65, 69, 72, 78, 104, 107, 112, 126, 138, 141, and 153.
89. A method for treating a cancer in a subject in need thereof comprising the step of administering to a subject having a cancer classified or diagnosed as having poor prognosis or being malignant, using the method of any one of paragraphs 24-61, or the assay of any one of paragraphs 62-79, at least one proteasome inhibitor in a pharmaceutically acceptable carrier.
90. The method of paragraph 89, wherein the at least one proteasome inhibitor is an siRNA or antisense RNA agent.
91. The method of any one of paragraphs 89-90, wherein the proteasome inhibitor specifically inhibits a proteasomal malignancy associated response signature biomarkers set forth in SEQ ID NOs: 1, 2, 4, 7, 15, 16, 21, 29, 33, 34, 38, 60, 74, 76, and 149.
92. The assay of any one of paragraphs 89-90, wherein the at least one proteasome inhibitor specifically inhibits the malignancy associated response signature biomarker set forth in SEQ ID NOs: 134 (MCL-1).
93. The method of paragraph 89, wherein the proteasome inhibitor is bortezomib.
94. A method for treating a cancer in a subject in need thereof comprising the step of administering to a subject having a cancer classified or diagnosed as having poor prognosis or being malignant, using the method of any one of paragraphs 24-61, or the assay of any one of paragraphs 62-79, at least one histone deacetylase inhibitor in a pharmaceutically acceptable carrier.
95. The method of paragraph 92, wherein the at least one histone deacetylase inhibitor is an siRNA or antisense RNA agent.
96. The method of paragraph 93, wherein the at least one histone deacetylase inhibitor is trichostatin A (TSA) or Vorinostat.
97. A method for treating a cancer in a subject in need thereof comprising the step of administering to a subject having a cancer classified or diagnosed as having poor prognosis or being malignant, using the method of any one of paragraphs 24-61, or the assay of any one of paragraphs 62-79, at least one metabolic inhibitor in a pharmaceutically acceptable carrier.
98. The method of paragraph 97, wherein the at least one metabolic inhibitor is an siRNA or antisense RNA agent.
99. The method of any one of paragraphs 97-98, wherein the at least one metabolic inhibitor specifically inhibits a metabolic malignancy associated response signature biomarker set forth in SEQ ID NOs: 46, 49, 65, 69, 72, 78, 104, 107, 112, 126, 138, 141, and 153.
100. A system for obtaining data from at least one sample from a subject having a cancer, the system comprising:
   a. a determination module configured to receive said at least one sample from a subject having a cancer and perform an expression analysis of ten or more malignancy associated response signature biomarkers set forth in SEQ ID NOs: 1-154 on said at least one sample to generate an expression data output;
   b. a storage device configured to store said expression data output from said determination module;
   c. a comparison module configured to receive said expression data output of the sample from the subject having a cancer and perform at least one expression analysis on said expression data output to determine the presence or absence of one of the following conditions and produce a comparison data output:
      i. the sample from the subject having a cancer has increased expression of ten or more metabolic malignancy associated response signature biomarkers set forth in SEQ ID NOs: 1-154; or
      ii. the sample from the subject having a cancer does not have increased expression of ten or more metabolic malignancy associated response signature biomarkers set forth in SEQ ID NOs: 1-154; and
   d. an output or display module for displaying a content based in part on the comparison data output from said comparison module, wherein the content comprises a signal indicative that the sample from the subject having a cancer has increased expression of ten or more metabolic malignancy associated response signature biomarkers set forth in SEQ ID NOs: 1-154, or a signal indicative that the sample from the subject having a cancer does not have increased expression of ten or more metabolic malignancy associated response signature biomarkers set forth in SEQ ID NOs: 1-154.
101. The system of paragraph 100, wherein the content displayed on said display module further comprises a signal indicative of the subject being recommended to receive a particular treatment regimen.
102. A method of identifying a candidate therapeutic agent against a cancer initiating cell comprising the step of
   a. exposing a BPLER cell culture to a test agent, wherein said BPLER cell culture comprises human breast primary epithelial cells (BPE) transformed with a defined set of genetic elements;
   b. measuring expression of at least ten of the 154 malignancy associated response signature biomarkers of paragraph 1 in the culture,
   c. comparing the expression of the same at least 10 biomarkers of malignancy associated response signature biomarkers of paragraph 1 as was measured in step (b) to an expression signature reference from a BPLER cell culture that has not been exposed to the test agent, wherein a decrease of expression of at least 5 of the at least 10 genes in the test culture compared to the expression signature reference indicates that the test agent is a candidate therapeutic agent against a cancer initiating cell.
103. A therapeutic agent identified by the method of paragraph 102.
104. The therapeutic agent of paragraph 103, wherein said agent is an siRNA agent, an antisense RNA agent, an antibody or antigen-binding fragment thereof, or a small molecule compound.
105. A pharmaceutical compound comprising the therapeutic agent of paragraph 103 and a pharmaceutically acceptable carrier.

Unless otherwise defined herein, scientific and technical terms used in connection with the present application shall have the meanings that are commonly understood by those of ordinary skill in the art to which this disclosure belongs. It should be understood that this invention is not limited to the particular methodology, protocols, and reagents, etc., described herein and as such can vary. The terminology used herein is for the purpose of describing particular embodiments only, and is not intended to limit the scope of the present invention, which is defined solely by the claims. Definitions of common terms in immunology, and molecular biology can be found in The Merck Manual of Diagnosis and Therapy, 18th Edition, published by Merck Research Laboratories, 2006 (ISBN 0-911910-18-2); Robert S. Porter et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006. Definitions of common terms in molecular biology are found in Benjamin Lewin, Genes IX, published by Jones & Bartlett Publishing, 2007 (ISBN-13: 9780763740634); Kendrew et al. (eds.), The Encyclopedia of Molecular Biology, published by Blackwell Science Ltd., 1994 (ISBN 0-632-02182-9); and Robert A. Meyers (ed.), Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques Vol. 152, S. L. Berger and A. R. Kimmerl Eds., Academic Press Inc., San Diego, USA (1987); Current Protocols in Molecular Biology (CPMB) (Fred M. Ausubel, et al. ed., John Wiley and Sons, Inc.), Current Protocols in Protein Science (CPPS) (John E. Coligan, et. al., ed., John Wiley and Sons, Inc.) and Current Protocols in Immunology (CPI) (John E. Coligan, et. al., ed. John Wiley and Sons, Inc.), which are all incorporated by reference herein in their entireties.

It should be understood that this invention is not limited to the particular methodology, protocols, and reagents, etc., described herein and as such can vary. The terminology used herein is for the purpose of describing particular embodiments only, and is not intended to limit the scope of the present invention, which is defined solely by the claims.

All patents and other publications identified are expressly incorporated herein by reference for the purpose of describing and disclosing, for example, the methodologies described in such publications that could be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

This invention is further illustrated by the following examples which should not be construed as limiting.

EXAMPLES

Example 1

BPLER and HMLER Breast Cancer Cells Retain Progenitor-Like and Myoepithelial-Like Features, Respectively It has been shown that different populations of human breast primary epithelial cells (BPE and HME), selected in chemically-defined media (e.g., WIT-T and MEGM, respectively), give rise to distinct tumor phenotypes upon transformation with the same set of genetic elements (e.g., hTERT, SV40 early region and h-RAS$^{V12}$), indicating that key properties of a tumor can be predetermined by its cell of origin. BPE transformed derivatives (BPLER) are highly malignant, whereas HME transformed derivatives (HMLER) are poorly tumorigenic compared to BPLER cells, although the two cell lines proliferate at a similar rate in vitro. As described herein, we have determined that such properties can be associated with a different state of differentiation.

To exclude any effects related to cell culture medium or substrate, all experiments described herein were performed by propagating BPLER and HMLER cells in the same medium (WIT-T) in standard tissue culture plates, which did not alter the relative rate of proliferation. Under these conditions, BPLER cells expressed a wide array of luminal and myoepithelial cytokeratins, including CK5, CK14, CK17, CK8, and CK18, consistent with an epithelial progenitor-like phenotype, whereas HMLER cells expressed lower levels of most cytokeratins except CK5. Accordingly, BPLER cells retained an epithelial morphology and co-expressed CK14 and CK18 proteins at the single-cell level, a property of mammary epithelial progenitors and terminal duct lobular unit (TDLU) cells, from which breast cancer is believed, without wishing to be bound or limited by theory, to originate. BPLER cells also expressed E-cadherin and Vimentin transcripts, whereas HMLER cells expressed higher levels of vimentin but lower levels of E-cadherin transcripts. Both cell lines were triple-negative (ER–, PR–, HER–) and expressed EGFR mRNA.

Together, these data demonstrate that BPLER cells retain a progenitor-like phenotype, expressing both luminal and myoepithelial markers, whereas HMLER cells retain a more committed myoepithelial phenotype. These findings confirm at a protein level previous microarray-based studies, which showed a mixed luminal/myoepithelial and myoepithelial-like transcriptional profile associated with BPLER and HMLER cells, respectively.

BPLER Cells have Properties of Basal-Like Breast Tumor-Initiating Cells.

The phenotypic features of BPLER cells are similar to poor prognosis human basal-like breast tumors (BL-BTs), which are enriched in breast tumor-initiating cells (BT-ICs). We found that BPLER cells retained high tumor-initiating potential, demonstrated by their ability to form tumors in mice with as few as 50 cells. In contrast, we found that HMLER cells did not initiate tumors in mice with 5×10$^4$ or fewer cells, indicating that most HMLER cells had shed their tumor-initiating potential.

The bulk of BPLER cells displayed a CD44$^+$/CD24$^{low/-}$/ESA$^+$ antigenic configuration, which was previously associated with human BT-ICs. However, we show that these markers are not sufficient to specify the tumor-initiating state, because poorly malignant HMLER cells also displayed a similar phenotype.

To define clinical parameters, histological features of tumors originated from BPLER cells were first analyzed. BPLER xenografts stained positive for CK5 and CK14 and were negative for ER, were highly proliferative (as determined by Ki-67 staining), had a high mitotic index (as determined by phospho-Histone H3 staining), displayed a clear inflammatory infiltrate, a discernible tumor stroma, pushing borders, and had alternated areas of glandular focal differentiation with poorly differentiated areas, all of which are characteristic properties of human basal-like tumors. Further, only BPLER cells that established direct contact with the stroma retained vimentin expression, which was undetectable in the remaining cells, i.e., BPLER cells not having direct contact with the stroma. Because vimentin is typically repressed in differentiated epithelial cells, this indicates that the tumor stroma plays a role in maintaining the relatively uncommitted state of BPLER cells in vivo.

Accordingly, BPLER cells give rise to tumors closely resembling human basal-like tumors at the histological level.

To further corroborate these findings, we compared the global transcriptional profile of six different BPLER tumor explants, derived from either Nude or NOD/SCID mice, with a set of 337 human primary tumors of known subtype (UNC337 dataset). To reduce background signal derived from human stroma, as opposed to BPLER mouse stroma, we adopted a principal component (PC) approach. All BPLER tumor explants clustered with human primary triple-negative breast tumors, and not with luminal, normal, or HER-2 subtypes. We further validated these findings using an independent set of 47 human primary breast tumors (Richardson-06 dataset), in which BPLER tumor explants also clustered with triple-negative tumors.

Accordingly, as demonstrated herein, BPLER cells not only have properties of BT-ICs, but also initiate tumors with global features of human primary basal-like breast tumors, thus representing a model of basal-like BT-ICs.

A Genome-Wide siRNA Screen Identifies Factors Required for Survival of Basal-Like BT-ICs The data described herein so far demonstrate that BPLER and HMLER cells retain high and low tumor-initiating potential, respectively. Moreover, BPLER cells display several features of human basal-like breast cancer, including malignancy, cytokeratin expression, hormone receptor status and CD44/CD24 antigenic configuration, and form tumors closely resembling human basal-like breast cancer.

To identify survival factors associated with the tumor-initiating state, we performed a genome-wide siRNA lethality screen using BPLER and HMLER cell lines, which were derived from the same patient, harbored the same set of genetic elements, and proliferated at a similar rate, but were differentially malignant. By silencing one gene at a time, a comprehensive overview of the key mechanisms supporting the growth of highly malignant basal-like breast cancer cells was obtained, and revealed novel diagnostic biomarkers and therapeutic targets for more effective targeted diagnosis of and therapies against basal-like breast tumors.

The screen was organized into separate modules, each of which was developed independently. The assay was optimized to identify candidate genes required for survival of either BPLER or HMLER cells in an unbiased way on a genome-wide scale. We used siRNA libraries including 17,378 siRNA pools, each containing 4 distinct siRNAs targeting the same gene, which were screened in triplicate for each cell line.

A total of 1025 siRNA pools decreased BPLER viability, of which 780 also decreased HMLER viability. These siRNAs include hits not associated with malignancy but more generally affecting proliferation or survival, the global silencing of which has a greater likelihood of being cytotoxic to all cell types. For example, the top 20 hits in this category included PLK1, KIF11, RRM2, BCL-XL and POL2RA, all of which are well-known regulators of basic cellular functions (Table 1).

The remaining 245 pools were highly, moderately, and modestly selective siRNAs preferentially inhibiting BPLER cells as opposed to HMLER cells, and were therefore associated with tumor-initiating potential (Tables 2A-2C).

To further increase confidence in these hits, a secondary screen was performed (termed herein as a "cherry-pick screen") transfecting the 4 siRNAs comprising each pool individually. Hits were confirmed if at least one out of four siRNAs scored positive in the secondary screen, since several siRNA pools used in the primary screen are predicted to contain only one functional siRNA. A total of 154 hits were confirmed in the cherry-pick screen, where validation rates were 88%, 75% and 52% for highly, moderately, and poorly selective hits, respectively (Table 3). These 154 high-confidence hits represent genes on which BPLER cells selectively depend for survival, and therefore comprise a functional module associated with tumor-initiating potential, referred to herein as a "Triple Negative Breast Cancer Gene Signature" (TGS) or a "Malignancy-Associated Response Signature" (MARS), as termed herein.

Poor Prognosis Human Breast Primary Tumors are Enriched for Genes Required for BPLER Survival Having identified genes selectively required for survival of BPLER cells, we next determined that such genes were enriched in malignant human primary breast tumors. A single sample GSEA approach was used to project the TGS (MARS) gene set across a set of 47 human breast primary tumors and normal breast tissues (DFHCC3 dataset). A significant positive correlation was observed between the expression of TGS (MARS) genes and the primary tumor expression profiles (p<1.2e-05), indicating that most genes were enriched in malignant breast lesions compared to normal breast tissue.

Next, we assessed whether TGS (MARS) expression was specifically associated with poor prognosis breast tumors, which are enriched in BT-ICs, in an independent set of 295 human breast primary tumors with annotated clinical and molecular subtype data (NKI dataset). TGS (MARS) expression positively correlated with shorter survival (p<0.003), demonstrating that highly malignant cancer cells within primary tumors retain the expression of genes required for survival of BPLER cells.

To define whether basal-like primary tumors, in particular, were enriched in TGS (MARS) genes, we assessed their expression in the different subtypes of breast cancer within the NKI dataset. TGS (MARS) genes were retained in highly malignant basal-like breast cancers, as compared to HER-2, luminal A, and "normal" breast cancers ($p<2.61\times10^{-5}$). Notably, TGS (MARS) genes were also enriched in Luminal B tumors ($p<3.79\times10^{-6}$). These tumors comprise ~15% of human breast tumors and have variable prognosis. Luminal B tumors are ER positive, much like good prognosis luminal A tumors, but are also moderately differentiated, resembling poor prognosis basal-like tumors. We next determined whether TGS (MARS) enrichment separates tumors with different prognosis within the luminal B category. Impressively, two luminal B patient subgroups with markedly different survival were identified based on TGS (MARS) expression. No significant differences in survival were observed within the other subtypes using the same approach. These data further demonstrate the association between TGS (MARS) and malignancy, which appears, without wishing to be bound or limited by theory, to be independent from the tumor subtype.

Metastasis is the leading cause of death in breast cancer patients. We next determined whether metastatic tumors were also enriched in TGS (MARS) genes. We found that within the NKI dataset, patients with higher TGS (MARS) expression developed metastasis significantly earlier than patients with TGS expression (p<0.01). To further confirm these results, we performed an analysis of TGS (MARS) expression in 560 primary breast tumors collated from three independent datasets (EMC286, MSK82, EMC192), for which metastatic relapse data were available. In this setting, patients with higher TGS (MARS) expression also had a significant shorter metastasis-free survival (p<0.002).

In conclusion, the expression of TGS (MARS) genes was retained in a variety of malignant disease conditions, confirming the clinical relevance of the genes identified in our screens described herein as novel diagnostic and prognostic biomarkers and therapeutic targets.

BPLER Cells are Selectively Sensitive to Proteasome and Glycolysis Inhibitor Drugs To determine the biological functions of the TGS genes, their enrichment in canonical pathways was assessed. The most significantly enriched pathways included Proteasome Degradation, Glycolysis, TNFα/NFκB signaling, IL-7 signaling, mRNA processing, Transcription Initiation, ID signaling, and GPCR Class A Rhodopsin-like. An approach based, in part, on the Pathway Expansion Analysis (PEXA) of Tu et al. was used to establish how these pathways are related to the TGS genes and identify the underlying mechanisms that drive their observed effects. This analysis leveraged pathway and interaction curation to identify a high-confidence core interaction network. The network from these analyses included a large number of TGS genes that interacted directly at the protein level, or were functionally related, supporting a coherent biological relationship within TGS genes.

To establish which of these pathways correlated with the basal-like phenotype in breast cancer patients, and select biological pathways for therapeutic intervention, we analyzed the expression of TGS-associated pathways in human primary breast tumors. Indeed, Proteasome, Proteasome degradation, Glycolysis, mRNA Processing, and TNF-alpha pathways were selectively enriched in poor prognosis basal-like tumors compared to good prognosis luminal A tumors, but not IL-7 signaling, ID signaling, GPCR Class A Rhodopsin-like and Transcription Initiation. Notably, pathways enriched in basal-like primary tumors were also enriched in Luminal B tumors.

Indeed, the integration of genome-wide functional and expression data allows us to identify and select biological pathways the inhibition of which can be therapeutically effective in the context of basal-like breast tumors, because they are required for survival of highly malignant basal-like breast cancer cells, and are also enriched in human primary BL-BTs.

To further support these results, we further validated some of these pathways functionally. Proteasome Degradation and Glycolysis pathways were particularly attractive because chemical inhibitors are available. Moreover, Proteasome Degradation was the pathway most highly represented in the TGS genes, and also the most connected, as the hits were all subunits of the 20S or 26S proteasome complexes. These included PSMA1, PSMA2, PSMA3, PSMB4, PSMC1, PSMC3, PSMD2, PSMD7, and PSMD14. Moreover, other TGS genes, such as UBL5, NEDD1, NEDD8, ANAPC2, and ANAPC4, were also involved in the ubiquitin-proteasome system. On the other hand, only two hits were associated with Glycolysis, PFKL and GAPDH pathways but their enrichment in the TGS was highly significant. HK1, which initiates glucose catabolism through the same pathway, also scored positive in the primary screen, but could not be validated in the secondary screen. Most of the screening hits in these pathways were classified as highly or intermediate BPLER selective inhibitors, and could each be validated with 2-4 individual siRNAs in the secondary screen.

We used chemical inhibitor drugs to further confirm the selective response of BPLER and HMLER cells to inhibition of proteasomal activity or glycolysis in an RNAi-independent manner. Indeed, BPLER cells were more sensitive to increasing doses of bortezomib (a proteasome inhibitor drug) and 3-bromo-pyruvic acid (BRPA, a chemical inhibitor of glycolysis) relative to HMLER cells. Treatment with bortezomib decreased proteasomal activity similarly in both cell lines, demonstrating that BPLER cells were intrinsically more sensitive to transient proteasomal inhibition. Exposure to BRPA for 4 hours, when most cells were viable, decreased ATP levels in BPLER and HMLER cells by 90% and 60% respectfully, indicating, without wishing to be bound or limited by theory, a higher dependence of BPLER cells on glycolysis for ATP generation. However, this might also indicate, without wishing to be bound or limited by theory, a differential ATP consumption rate between the two cell lines. Notably, the exquisite sensitivity of BPLER cells to bortezomib and BRPA was drug-specific, because BPLER and HMLER cells responded similarly to treatment with the anthracycline doxorubicin.

To further validate the correlation between tumor-initiating potential and response to either proteasome or glycolysis inhibition, we assessed the dependency of untransformed BPE cells on these pathways. Although BPE were as proliferative as HMLER and BPLER cells, they were resistant to both proteasome and glycolysis inhibitors, further confirming the specificity of these drugs for highly malignant breast cancer cells.

While glycolysis inhibitors are in pre-clinical development, proteasome inhibitors are already in the clinic for the treatment of multiple myeloma and mantle cell lymphoma, and can be rapidly investigated for breast cancer therapy in a clinical setting. Nonetheless, some phase I/II clinical studies have shown poor response of unselected breast cancer patients to proteasome inhibitors. Accordingly, we furthered explored and determined the molecular basis of BPLER dependence on the proteasome degradation pathway for survival.

Proteasome Inhibition Selectively Promotes Noxa-Dependent Apoptosis in Basal-Like Breast Cancer Cells The data described herein show that highly malignant BPLER cells selectively depend on proteasomal activity for survival compared to poorly malignant HMLER cells and untransformed breast primary epithelial BPE cells. To further define factors underlying such properties of BPLER cells, we first determined the molecular mechanism by which proteasome inhibition affects the growth of these cells. Treatment with clinically relevant doses of bortezomib for 24 hours induced marked cleavage of caspase 3 and PARP in BPLER cells, but only partially in HMLER cells and not in BPE cells, indicating selective activation of apoptosis in BPLER cells. Likewise, upon treatment with low-dose bortezomib, 34%, 17% and 2% of BPLER, HMLER and BPE cells stained positive for Annexin V/PI, whereas co-treatment with the pan-caspase inhibitor ZVAD dramatically reduced the number of double-positive cells, further demonstrating the selective induction of caspase-dependent cell death in BPLER cells upon proteasome inhibition.

Other basal-like breast cancer cell lines, such as HCC-1143 and HCC-1937, were also exquisitely sensitive to proteasome inhibition compared to mesenchymal MDA-MB-231 and MDA-MB-436 or luminal MCF7 and BT-474 breast cancer cell lines. In fact, treatment with bortezomib decreased cell viability by 50-65% in basal-like cells, but only by 20-25% in mesenchymal cells and 5% in luminal cells. Moreover, bortezomib induced PARP cleavage in both HCC1143 and HCC1937 cells, but not in MCF7 or MDA-MB-436 cells. Therefore, as shown herein, the selective response to proteasome inhibitors is an intrinsic feature of human basal-like breast cancer cells, and not limited to BPLER cells.

BH3-only proteins have been shown to mediate bortezomib-induced apoptosis in multiple myeloma cells, which are also exquisitely sensitive to inhibition of the proteasome. We assessed the levels of these proteins in BPLER cells upon treatment with bortezomib. Notably, the BH3-only protein Noxa was highly increased in treated cells, whereas other BH3-only proteins were only modestly increased (e.g., Bik, Bim), unchanged (e.g., Bid, Bad), or decreased (e.g., Puma).

Indeed, we determined that Noxa was necessary to mediate apoptosis in BPLER cells, because its silencing by RNAi partially rescued the lethal effect of proteasome inhibition in BPLER cells, similar to the pan-caspase inhibitor ZVAD. On the other hand, silencing Bim or Bik did not rescue BPLER cells from cell death, whereas silencing both Bik and Noxa simultaneously did not further increase cell viability upon proteasome inhibition. Finally, Noxa was also induced in the bortezomib-responsive cell lines HCC1143 and HCC1937 cells, and not in bortezomib-resistant luminal MCF7 cells, further confirming the central role of Noxa in mediating bortezomib-induced cell death. However, Noxa did not appear sufficient to activate apoptosis, because it was similarly induced in HMLER cells and MDA-MB-231 cells upon treatment with bortezomib. Although Noxa was barely detectable at the protein level in all untreated cells, it was actively transcribed in triple-negative breast cancer cells compared to luminal breast cancer cells and untransformed breast epithelial cells, indicating, without wishing to be bound or limited by theory, that triple-negative cells have high ability to induce Noxa because of high baseline mRNA levels. Noxa mRNA was only modestly increased in BPLER and HMLER cells upon proteasome inhibition, despite a strong induction of Noxa protein in both cell lines. Together, these findings demonstrate that basal-like breast cancer cells undergo Noxa-dependent apoptosis upon proteasome inhibition.

Proteasome Inhibitors Interfere with Mitosis in Highly Malignant Basal-Like Breast Cancer Cells.

The proteasome is a key regulator of cell cycle. We next determined whether the selective response of BPLER cells to proteasome inhibitors is linked to an abnormal regulation of cell cycle dynamics. To define the physiological response of normal breast epithelial cells to proteasome inhibition, we analyzed the cell cycle distribution of BPE cells treated with bortezomib for 24 hours, which showed a marked accumulation of cells in G2/M phase. A similar response was observed in HMLER cells, and BPLER cells treated with suboptimal doses of bortezomib. Accordingly, proteasome inhibition induced a marked increase of p21 and p27 proteins, two main cell cycle inhibitors, in all the three cell lines.

To exclude secondary effects of apoptosis, and track progression through different cell cycle phases, we analyzed cell cycle distribution upon proteasome inhibition in BPE, HMLER and BPLER cells in the presence of the pan-caspase inhibitor ZVAD, which inhibits apoptosis induced by proteasome inhibition, and nocodazole, which arrests cells as they reach mitosis.

All the three cell lines underwent mitotic arrest when treated with nocodazole for 24 hours. Addition of bortezomib delayed progression to G2/M phase in BPE cells and, to a lesser extent, HMLER cells, but not in BPLER cells. Notably, BPLER cells failed to arrest in G1 or G2 phases and entered mitosis, upon proteasome inhibition, whereas BPE cells and, in part, HMLER cells remained in interphase, as determined by morphology, Histone H3 phosphorylation and DNA staining. Likewise, HCC1143 basal-like breast cancer cells entered mitosis upon proteasome inhibition.

Basal-like breast cancer cells are known to be highly sensitive to antimitotic agents. Because proteasomal activity drives exit from mitosis, we next determined whether proteasome inhibition interfered with mitosis in BPLER cells. When apoptosis was blocked by ZVAD, proteasome inhibition delayed the exit from mitosis of BPLER cells that were first synchronized with nocodazole. Notably, a mitotic arrest achieved by nocodazole treatment for 24 hours was sufficient to activate apoptosis in BPLER cells, although not as much as proteasome inhibition, indicating that disruption of normal mitosis contributed to bortezomib-induced apoptosis. Indeed, bortezomib appeared to act as an antimitotic agent, but was more potent compared to nocodazole, presumably because of concomitant induction of proapoptotic factors such as Noxa. Importantly, BPLER cells became resistant to bortezomib treatment once they reached confluence, further supporting a higher sensitivity of dividing cells to proteasome inhibitors.

Accordingly, these data show basic mechanisms of action of bortezomib in basal-like breast cancer cells, which involve, in part, inactivation of the G2/M checkpoint and disruption of normal mitosis.

Proteasome Inhibition Inhibits the Outgrowth of Basal-Like Breast Tumors

Although breast cancer patients have previously been shown to respond poorly to proteasome inhibitors, we next determined whether bortezomib exerts an antitumoral effect on basal-like breast cancer cells in vivo. For all the experiments described herein, bortezomib was given every three days (q3d), reflecting clinical protocols used in human patients, at doses of 0.5 mg/kg or 1.0 mg/kg intraperitoneally (i.p.), which were previously reported to be well-tolerated in mice. We did not observe any significant weight loss after 10-16 days of therapy, at which time points mice were sacrificed.

We first assessed the effect of bortezomib on pre-established subcutaneous BPLER xenografts in nude mice. The growth of BPLER tumors was influenced by host factors, and tumors developed between 2 and 5 weeks, even when high number of cells ($5 \times 10^5$) cell were injected. To reduce experimental variability, we selected mice bearing tumors of homogenous size (~0.5 mm in diameter after 3 weeks from injection), which were randomized into two groups. Each group received 6 doses of either vehicle (DMSO) or bortezomib at 0.5 mg/kg i.p. q3d over a 16-day period, respectively. At the end of the treatment period, mice were sacrificed and tumor weight was assessed. Treatment with bortezomib significantly reduced median tumor weight by 54% after 16 days (p=0.001). Histological examination of residual tumors revealed extensive cleaved caspase-3 positive apoptotic/necrotic areas in both treated and untreated tumors, which is a typical feature of human triple-negative breast tumors. We could not quantify with precision the relative effect of the treatment on apoptosis by immunohistochemistry alone. Although the histological picture was compatible with the induction of cell death, without wishing to be bound or limited by a theory, other mechanisms of tumor growth inhibition can also play a role.

To minimize host-related factors in inducing response to bortezomib, we decided to further validate these data in a syngeneic mouse model of basal-like breast cancer, where the influence of the immune system or other host factors is diminished.

In the course of our studies described herein, we identified a subpopulation of basal-like breast cancer cells within the 4T1 cell line, which derives from a spontaneous BALB/c mouse breast tumor. These cells, termed 4T1-E, display a $CD44^{med}/CDH1^{low}/ESA^{high}$ epithelial phenotype, whereas the remaining cells, termed 4T1-M, display a $CD44^{high}/CDH1^-/ESA^{low}$ mesenchymal phenotype. The two populations are stable, have a similar proliferation rate, and do not appear hierarchically linked, because they did not convert into each other after extensive culture in vitro.

Indeed, 4T1-E cells expressed higher levels of epithelial markers, including CDH1, ZO-1, CK-14 and EGFR, and lower levels of myoepithelial/mesenchymal markers, including Vimentin, MMP3 and Snail, compared to both 4T1-M cells as well as 67NR cells, which originate from an established mesenchymal clone previously isolated from the same tumor. Moreover, 4T1-E over-express the murine stem-like markers CD49f, CD24 and CD29 compared to 67NR cells. Finally, 4T1-E cells are more tumorigenic than 4T1-M cells and 67NR cells when transplanted in the mammary fat-pad of syngeneic mice, can form tumors with as few as 500 cells in syngeneic BALB/c mice after 3 weeks with complete penetrance, and give rise to highly malignant CK-14 positive epithelial breast tumors. Indeed, 4T1-E had a stem/progenitor-like phenotype, and recapitulated several features of BPLER cells and human basal-like breast tumors. 4T1-E also responded to bortezomib in vitro. Therefore, we assessed the therapeutic effect of bortezomib on the outgrowth of 4T1-E tumors in syngeneic BALB/c mice. Because all tumors grew very rapidly in this model, treatments were started 2 days after tumor cell inoculation. Similarly to BPLER xenografts, treatment with bortezomib (4 doses at 1.0 mg/kg i.p. q3d) reduced the median tumor weight by 56% after 10 days of treatment ($p<0.01$).

In conclusion, bortezomib exerts a significant therapeutic effect on basal-like tumors in vivo, although it does not induce complete remission of the tumors. Thus, in some embodiments of the methods described herein, a patient determined to have increased or enriched expression of at least one, or more preferably, at least 10 TGS biomarker genes in a tumor sample using the methods described herein, or a patient diagnosed having a basal-like breast tumor, can be further administered a proteosome inhibitor. In some such embodiments, the proteosome inhibitor is bortezomib.

Recent studies on animal models have indicated that basal-like breast tumors derive from transformed epithelial progenitors expressing both luminal and myoepithelial markers. Herein we demonstrated that human primary epithelial progenitor-like cells (BPE) give rise to tumors closely resembling human BL-BTs upon transformation with canonical oncogenes. Our data described herein indicate that epithelial progenitors retain the potential to initiate such tumors upon transformation. This is not an artifact of in vitro transformation, because introduction of the same genetic elements into myoepithelial-like cells (HME) did not induce the development of basal-like tumors. Moreover, the oncogenes used to transform BPE cells recapitulate common genetic alterations occurring in human BL-BTs, including loss of function of p53 and Rb (which are inactivated by SV40) and activation of RAS signaling. As shown herein, transformation of human primary cells into basal-like tumor-initiating cells appears dependent on the cell of origin. However, it is possible that other combinations of oncogenes can also induce basal-like phenotypes from different cells of origin.

BPLER cells represent a novel and the first genetically-defined model of a tumor-initiating cell with a basal-like phenotype. According to the cancer stem cell (CSC) hypothesis, only a minor subpopulation of cancer cells within a tumor retain tumor-initiating potential, whereas the bulk of tumor cells undergoes differentiation, thus shedding malignant properties. The CSC model can apply to certain low-grade tumors (including, e.g., luminal A breast tumors), in which cancer cells are capable of differentiation, however, human basal-like breast tumors are typically poorly differentiated lesions with a diffuse progenitor-like phenotype. In other tumors, where differentiation is impaired by genetic alterations, such as loss of p53, such as, for example, human basal-like breast tumors, the majority of cancer cells retain malignant potential. Our data demonstrate that human progenitor-like epithelial cells expressing BT-IC markers give rise to basal-like epithelial tumors, showing that at least certain stem-like features, such as self-renewal, can be acquired by epithelial progenitors as a result of transformation.

Previous studies have shown that passage through an epithelial-mesenchymal transition (EMT) generates mesenchymal cells with cancer stem-like properties. The pure mesenchymal phenotype does not appear to be a corollary of breast cancer "stemness," because BPLER cells retain both epithelial and mesenchymal features (i.e., a metastable phenotype) and are highly malignant, similar to 4T1-E mouse cells. Mesenchymal breast cancer cells have been shown to initiate tumors resembling claudin-low tumors or other rare mesenchymal breast cancer variants, but not basal-like epithelial tumors.

It should be noted that, since most of the established EMT markers are either luminal or myoepithelial transcripts, the metastable (mixed) phenotype is indicative of a progenitor-like state of differentiation. Therefore, metastable cells can represent early epithelial progenitors.

Unbiased forward genetic screens have been powerful tools with which to identify molecules involved in fundamental pathways in model organisms, but have been difficult to do in mammalian cells. The discovery of RNAi, coupled with the sequencing of the genome, has provided the opportunity to identify candidate genes required for a biological process in an unbiased way on a genome-wide scale by silencing one gene at a time. As described herein, we performed a genome-wide siRNA lethality screen to define functional vulnerabilities associated with the tumor-initiating state in the BPLER/HMLER system. We identified 154 therapeutic targets that can be harnessed for diagnosis, prognosis, and treatment of cancers, such as basal-like breast tumors. These targets are clinically relevant because they are enriched in human primary basal-like breast tumors and their expression correlates with poor prognosis and metastatic relapse. The prognostic value of these biomarker genes does not depend on their direct association with basal-like tumors, because they also discriminate between good and poor prognosis patients within the luminal B category.

In contrast to other breast cancer signatures, we have identified genes and pathways that are not only predictive of tumor subtype, prognosis, and risk of metastasis, but are also required for survival of basal-like BT-ICs in vitro. Importantly, the malignancy associated response signature genes described herein can be used to identify breast cancer patients who are at higher risk of death or metastasis, and who are more likely to respond to biological therapies targeting MARS-related genes or networks of genes.

Amongst the biological pathways selectively inhibiting BPLER cells, we focused, in part, on the proteasome-ubiquitin system, not just because it was one of the most significantly enriched for pathways, but also because proteasome inhibitor drugs are already in the clinic for multiple myeloma and relapsed mantle cell lymphoma. Although bortezomib is the only proteasome inhibitor approved for clinical use, 5 second-generation proteasome inhibitors are currently in phase I trials. Moreover, 10 drugs targeting specific E1-activating enzymes and E3-ubiquitin ligases are also in clinical development. It is believed that proteasome/ubiquitination inhibitors represent a novel class of drugs, whose number of potential targets may exceed protein kinases. Of note, BPLER cells also selectively responded to glycolysis inhibitors, which are currently in preclinical development. Accordingly, in some embodiments of the methods described herein, a subject having increased or enriched expression of at least one or more, preferably, at least 10, MARS (TGS) biomarker genes of SEQ ID NOs: 1-154 can be treated using any proteosome inhibitor, such as bortezomib and second-generation proteasome inhibitors in development, as well as drugs targeting specific E1-activating enzymes, E3-ubiquitin ligases, and inhibitors of glycolysis.

Treatment with bortezomib induced apoptosis in basal-like breast cancer cells, but not in luminal or mesenchymal breast cancer cells or in normal breast epithelial cells. Based on our data described herein, at least two mechanisms underlie such selectivity. First, basal-like cells are poised to undergo bortezomib-induced apoptosis, compared to luminal cells, because of active transcription of the proapoptotic factor Noxa mRNA, whose protein levels are kept in check by the proteasome. Second, consistent with their malignant nature, basal-like breast cancer cells are unable to activate cell cycle checkpoints upon proteasome inhibition, which represents the physiological response of normal breast epithelial cells. Indeed, proteasome inhibition interferes with mitosis exit, which represents a pro-apoptotic signal per se, because BPLER cells also responded to antimitotic agents.

Alteration of the G2/M checkpoint is a hallmark of human BL-BTs, for which treatment with antimitotic agents represents the standard of care. Bortezomib acted as an antimitotic agent by interfering with mitosis exit, but also induced the expression of potent pro-apoptotic molecules like Noxa. Significantly, proteasome inhibition was more effective than induction of mitotic arrest alone in eliminating basal-like breast cancer cells.

Little is known about the mechanisms linking mitotic arrest to apoptosis. It has been proposed that prolonged mitotic stall induces inactivating phosphorylation of anti-apoptotic BCL2-family proteins, including BCL2, BCL-XL and MCL1. Interestingly, we observed phosphorylation of MCL1 (a main antagonist of Noxa) in mitotic BPLER cells treated with bortezomib, which can contribute to induction of apoptosis upon proteasome inhibition.

Recent studies have shown that targeting mitosis exit by inhibiting CDC20, which links proteasomal activity with mitosis progression, leads to tumor regression in vivo. Our data demonstrate that proteasome-based therapies are effective against basal-like tumors in vivo as well. These date are in agreement with eight phase I/II studies assessing chemotherapy combination regimens with bortezomib, which showed partial response rates of 10-20% in unselected breast cancer patients.

Provided herein are novel insights into mechanisms of resistance in human cancer cells. We showed herein that non-dividing BPLER cells became resistant to bortezomib. However, six out of eight clinical studies assessing the effect of bortezomib on breast tumors were based on combination regimens with other drugs, such as doxorubicin, that are known to induce G1 arrest. Interestingly, administration of bortezomib in combination with docetaxel, which induces mitotic arrest, in one study compared favorably with patients treated with docetaxel alone.

On the other hand, our data indicate that basal-like tumors, but not luminal tumors, are more likely to respond to proteasome inhibitors. Because luminal tumors comprise over 70% of human breast cancers, a targeted approach aimed at identifying and selecting patients, based on expression of at least one, but more preferably at least 10 MARS biomarker genes, with basal-like tumors can increase response rates to proteasome inhibitors in the clinic. In conclusion, we identified core survival pathways on which basal-like BT-ICs depend for survival, and identified novel diagnostic, prognostic, and therapeutic biomarker targets with documented clinical relevance. Proteasome inhibition provides one therapeutic strategy to selectively tackle basal-like breast tumors. Other therapeutic approaches, such as glycolysis inhibition, can also be effective against poor prognosis breast tumors.

Example 2

Triple negative breast cancers (TNBC) are poor prognosis cancers, frequently associated with TP53 mutation and active RAS signaling. As described herein, we show that human progenitor-like primary mammary epithelial cells (BPE) selectively acquire TNBC-initiating properties after transformation with defined genetic elements. A genome-wide siRNA screen identified 154 genes upon which BPE transformed derivatives (BPLER) selectively depend for survival, compared to genetically identical myoepithelial-like cells from the same donor (HMLER). BPLER selective dependencies comprise a malignancy associated response signature (MARS) or TNBC gene signature (TGS) whose expression correlates with poor prognosis and metastasis in breast cancer patients. The MARS is enriched in proteasome-ubiquitin system, metabolism, RNA splicing, mitosis and molecular transport related genes. BPLER and human epithelial TNBC cell lines are poised to accumulation of the Mcl-1 antagonist Noxa and selectively depend on Mcl-1 for survival. In fact, proteasome inhibitor drugs target Mcl-1 dependency in these cells. Using "chemogenetics" to compare the MARS with gene expression signatures induced by >1,300 chemicals, we also identified histone deacetylase inhibitor drugs as selectively cytotoxic for BPLER. Thus, as described herein an unbiased siRNA screen identified novel classes of candidate drugs to treat TNBC.

Triple-negative breast cancers (TNBC), defined by their lack of estrogen (ER) and progesterone (PR) receptor and Her2 expression, are an especially aggressive group of tumors often found in young Afro-American and Hispanic women, with the shortest survival of breast cancer subtypes. TNBC, which comprise ~15% of human breast tumors, are associated with BRCA1 mutations and/or Tp53 and Rb loss of function in over 90% of cases[1]. Compared to ER+ luminal tumors, TNBCs are poorly differentiated and most cells have features of epithelial progenitor cells.[2,3] Targeted genetic ablation of Brca1, Tp53 and/or Rb in mammary epithelial progenitor cells in mice leads to TNBC-like malignancies, suggesting that TNBC arise from transformed epithelial progenitor cells[4-6]. TNBC generally express markers associated with breast tumor-initiating cells[7-9], $CD44^+/CD24^{low/-}/ESA^+$, EGFR and varied combinations of cytokeratins CK5, CK14, CK17, CK8, CK18[2]. These tumors rapidly become resistant to chemotherapy and are refractory to hormonal therapy and HER-2 inhibitors[1].

As described herein, we performed an unbiased genome-wide siRNA lethality screen to identify factors on which epithelial TNBC-initiating cells selectively depend for survival. For the screen we took advantage of a method to generate pairs of essentially genetically identical breast cancer cell lines, BPLER and HMLER, by transforming normal breast primary epithelial cells with defined genetic elements[10] (FIG. 1A). We found that BPLER cells, which derive from progenitor-like epithelial cells, have the phenotype of TNBC and retain TNBC-initiating potential, uniformly generating tumors that resemble primary TNBCs after injection of just 50 cells in immunodeficient mice, while HMLER cells are myoepithelial-like and do not form tumors after injection of $5 \times 10^4$ cells. Thus BPLER cells are a good model for studying malignant traits of TNBC. Knockdown of 154 genes selectively reduced the survival of BPLER cells compared to genetically related HMLER cells prepared from the same donor. These hits were highly enriched for components of the proteosome and for genes that participate in the ubiquitin-proteosome system (UPS) as well as for genes important in RNA splicing, glycolysis, DNA replication and mitosis. The 154 hits constitute a malignancy associated response signature (MARS) or TNBC gene signature (TGS) of genes whose expression is associated with reduced survival and early metastasis in human primary breast tumors. The MARS predicted that TNBC would be selectively vulnerable to proteosome and histone deacetylation inhibition. Indeed BPLER and TNBC cell lines were highly susceptible to these classes of drugs, providing novel approaches to treat this deadly disease that is largely refractory to current therapeutic regimens.

Results

BPLER Cells are Tumor-Initiating Epithelial Cells that Give Rise to TNBC

Figure 1B:
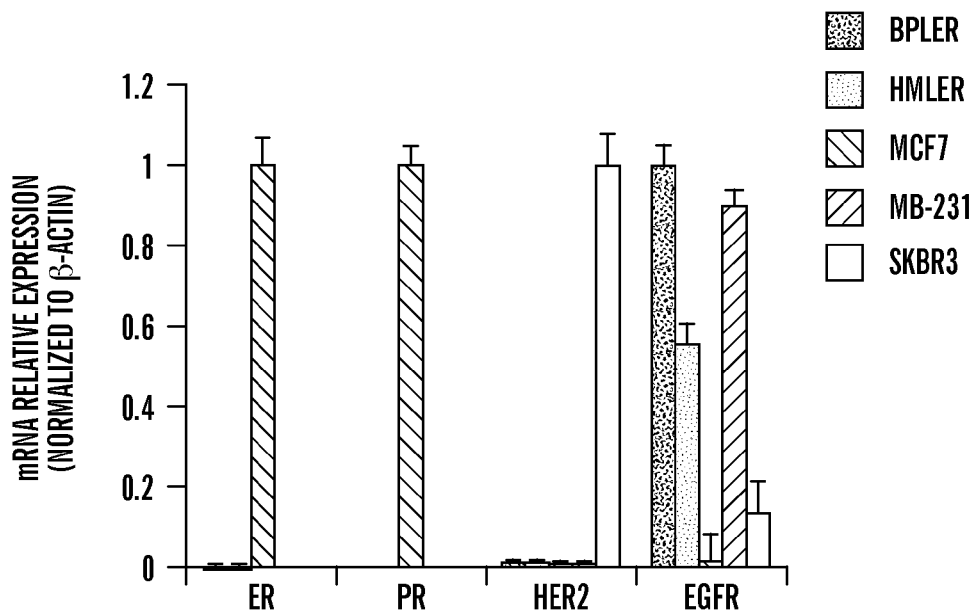
Figures 1C, 1D:
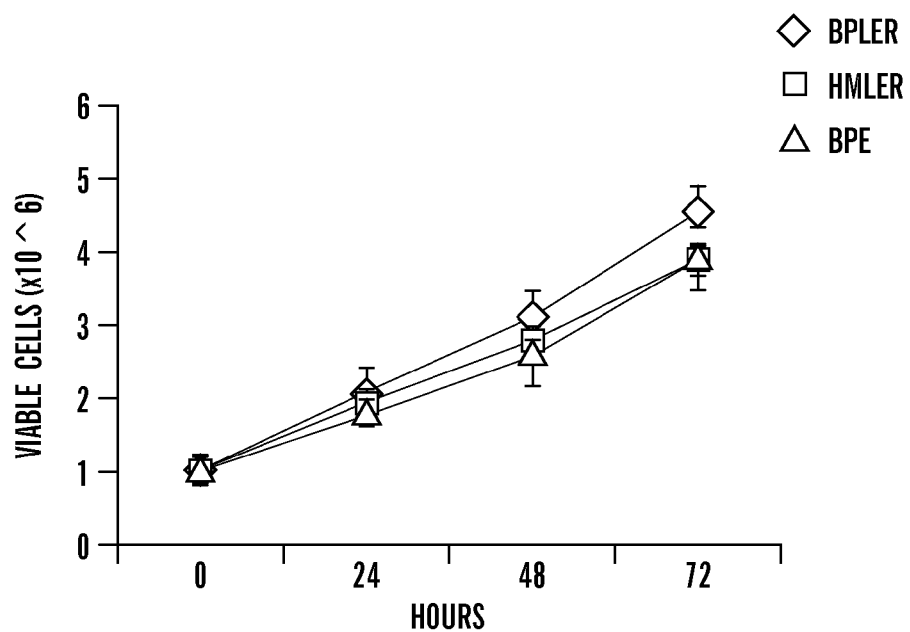
Figure 8A:
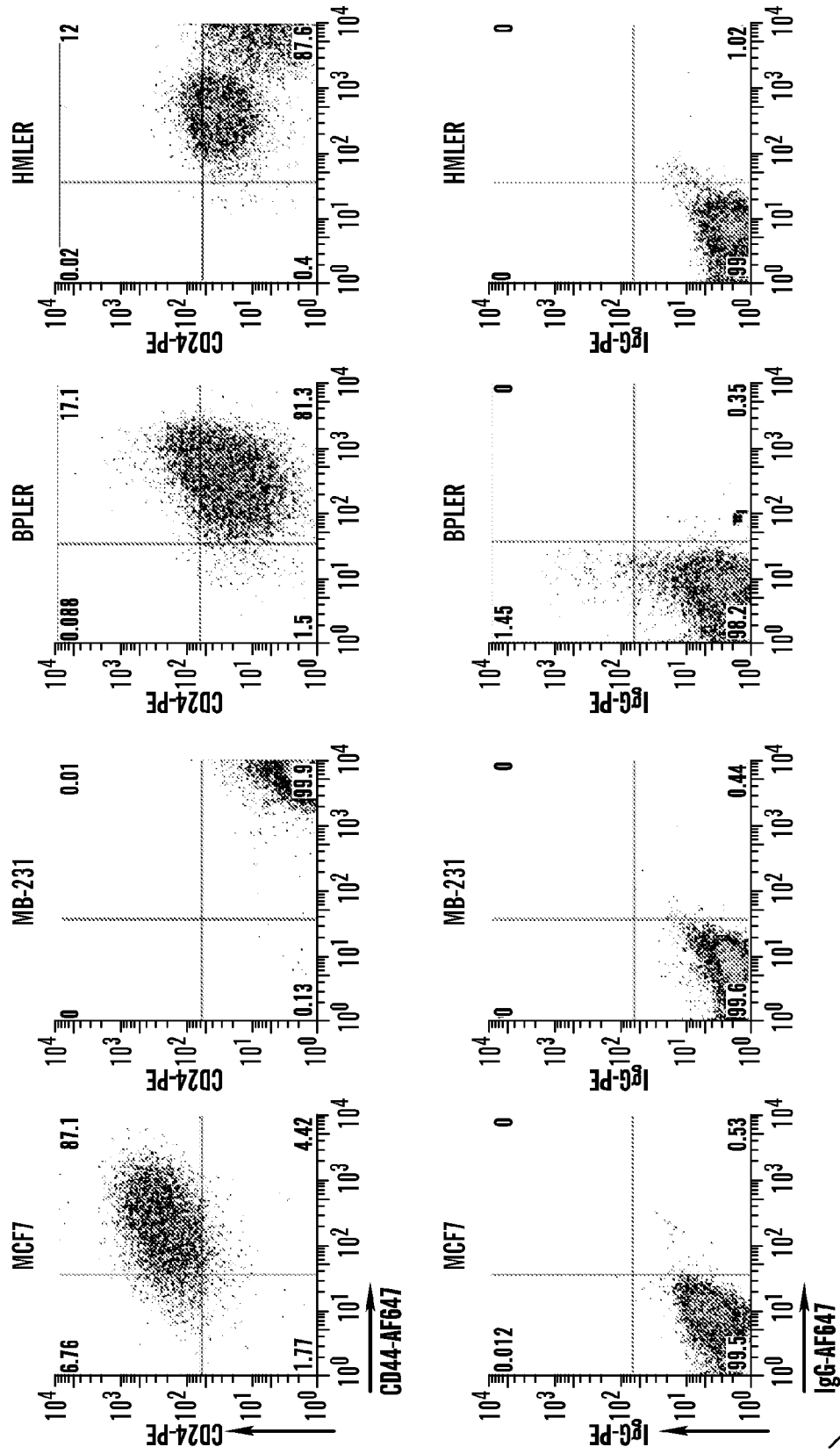
FIGS. 8A-8C demonstrate BPLER express epithelial breast tumor-initiating cell markers, retain an epithelial phenotype and form tumors that resemble TNBC in vivo (8A, 8B) Most BPLER and HMLER cells are CD44+/CD24$^{low}$ (8A) and ESA+ (8B) as assessed by flow cytometry. Luminal MCF7 and mesenchymal MDA-MB-231 were used as controls. (8C) Vimentin mRNA, assessed by qRT-PCR relative to β-actin, is poorly expressed, but clearly present, in BPLER compared to MDA-MB-231 and HMLER cells. MCF7 cells have no detectable vimentin mRNA. Data represent the mean+/−SD of 3 replicates. Data are representative of at least three independent experiments. Unsupervised hierarchical clustering of mRNA expression profiles of 6 BPLER tumors grown in immunodeficient mice, 40 human breast primary tumors (classified as either basal-like or non-basal-like), and 7 normal breast tissues (non-cancer, Richardson dataset[13]) was performed. BPLER tumors cluster with basal-like tumors, confirming data obtained with another tumor data set. Representative immunohistochemical staining of a BPLER tumor was performed. Intense staining indicated positivity for the indicated antigen.
Figure 8B:
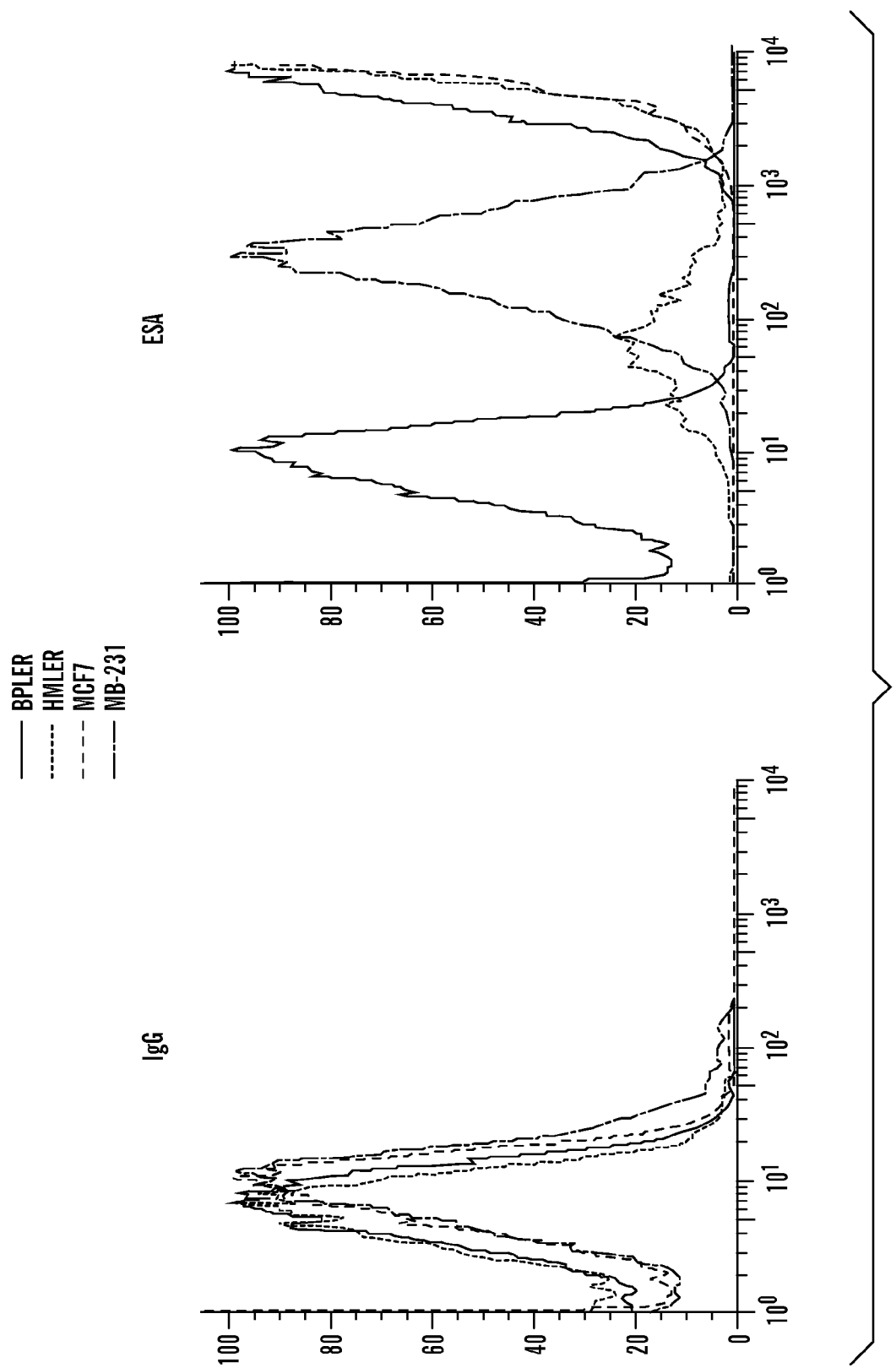
Figure 8C:
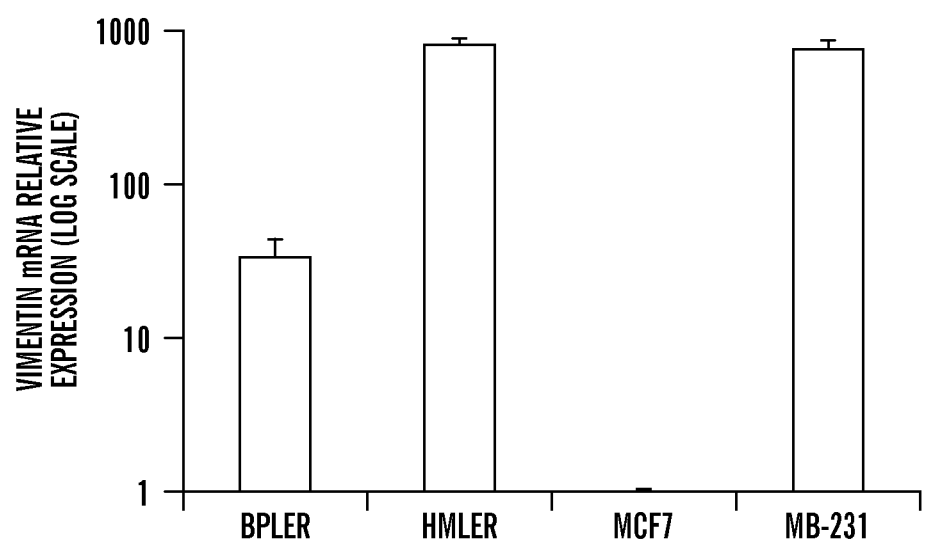
Figure 9A:
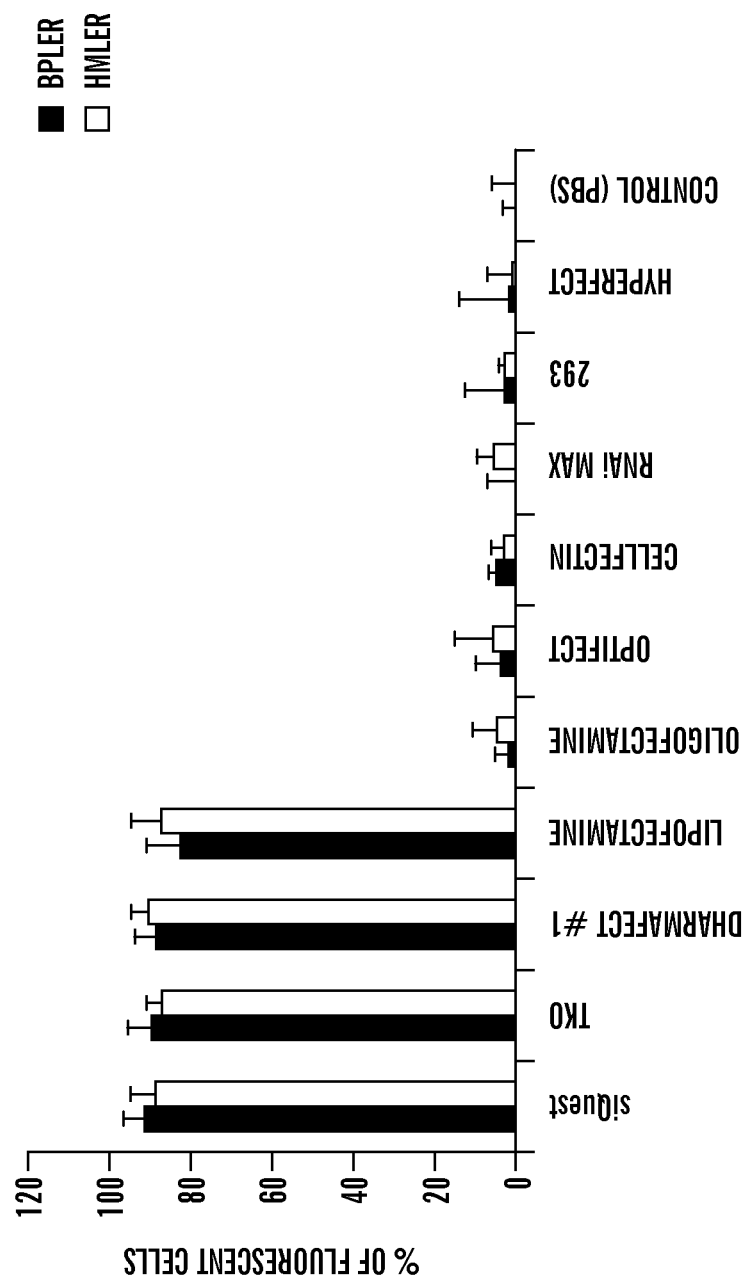
FIGS. 9A-9G depict siRNA screen optimization. (9A) Reverse-transfection efficiency of BPLER and HMLER cells in WIT medium in 384-well standard tissue culture plates was assessed by flow cytometry using 12 commercially available liposomal formulations complexed with Cy3-labeled siRNAs. Four transfection reagents were able to introduce Cy3-labeled siRNAs into both cell lines with ~90% efficiency. (9B) Only Dharmafect #1 (Dharmacon) and Lipofectamine 2000 (Invitrogen) had acceptable toxicity (<25% decrease in cell viability) when delivering control non-targeting siRNAs and induced cytotoxicity after transfection with a cytotoxic siRNA targeting PLK1. Titration of Dharmafect #1 reduced toxicity in both cell lines to <15% without loss of transfection efficiency (data not shown). Thus Dharmafect #1 was chosen for the screen and used in all subsequent experiments. (9C) Using Dharmafect #1, 13 pools of siRNAs from the Dharmacon library were transfected in both cell lines to identify additional positive controls besides PLK1. Transfection of PLK1 and KIF11 siRNA pools similarly reduced viability, measured by CellTiterGlo assay, of both BPLER and HMLER after 72 hr, whereas the other siRNAs had little effect. (9D) Optimal time for assessing cell viability was evaluated by assessing viability at indicated times after transfection. 72 and 96 hr gave similar results, preserving viability of cells treated with non-targeting siRNAs and inducing maximal cytotoxicity with PLK1 and KIF11 siRNAs. (9E) Durability of gene knockdown in BPLER/HMLER cells, transfected with 3 different non-cytotoxic siRNAs and assessed by qRT-PCR analysis of mRNA expression, showed potent silencing in both cell lines after 48 and 72 hr, which was reduced after 96 hr. Based on data in (9D, 9E), 72 hr was chosen as the optimal time to perform the viability assay for the screen. Values in (9A-9E) represent the mean+/−SD of three replicates. (9F) To determine an optimal cell density for the screen, a CellTiterGlo viability assay of BPLER (upper) and HMLER (lower) cells plated for 24 hr at the indicated cell numbers in 384-well plates. The CellTiterGlo signal was linear in the range from 0 to 3000 cells/well. Cells were plated at 1000 cells/well for all screening experiments (primary and secondary screens). All data in (9A-9F) are representative of at least three independent experiments. To assess reproducibility of the high throughput screening conditions, a prescreen was performed by transfecting cells with a custom-made siRNA library containing non-targeting siRNAs (192 wells/plate) or si-PLK1 (192 wells/plate). The Z' factor was calculated[44]. For both cell lines, Z'>0.7 in each of 6 microplates transfected in two separate experiments. An additional pre-screen was performed using a 500-siRNA library (Mitchison library), which returned 4 significant positive hits (data not shown). No edge effect was detected in any of these experiments. (9G) Ranked BPLER Z score values for all 17,378 genes represented in the siRNA primary screen library. A Z score with |Z|>1 is significant. We required hits to score with Z≤−1.5.
Figure 9B:
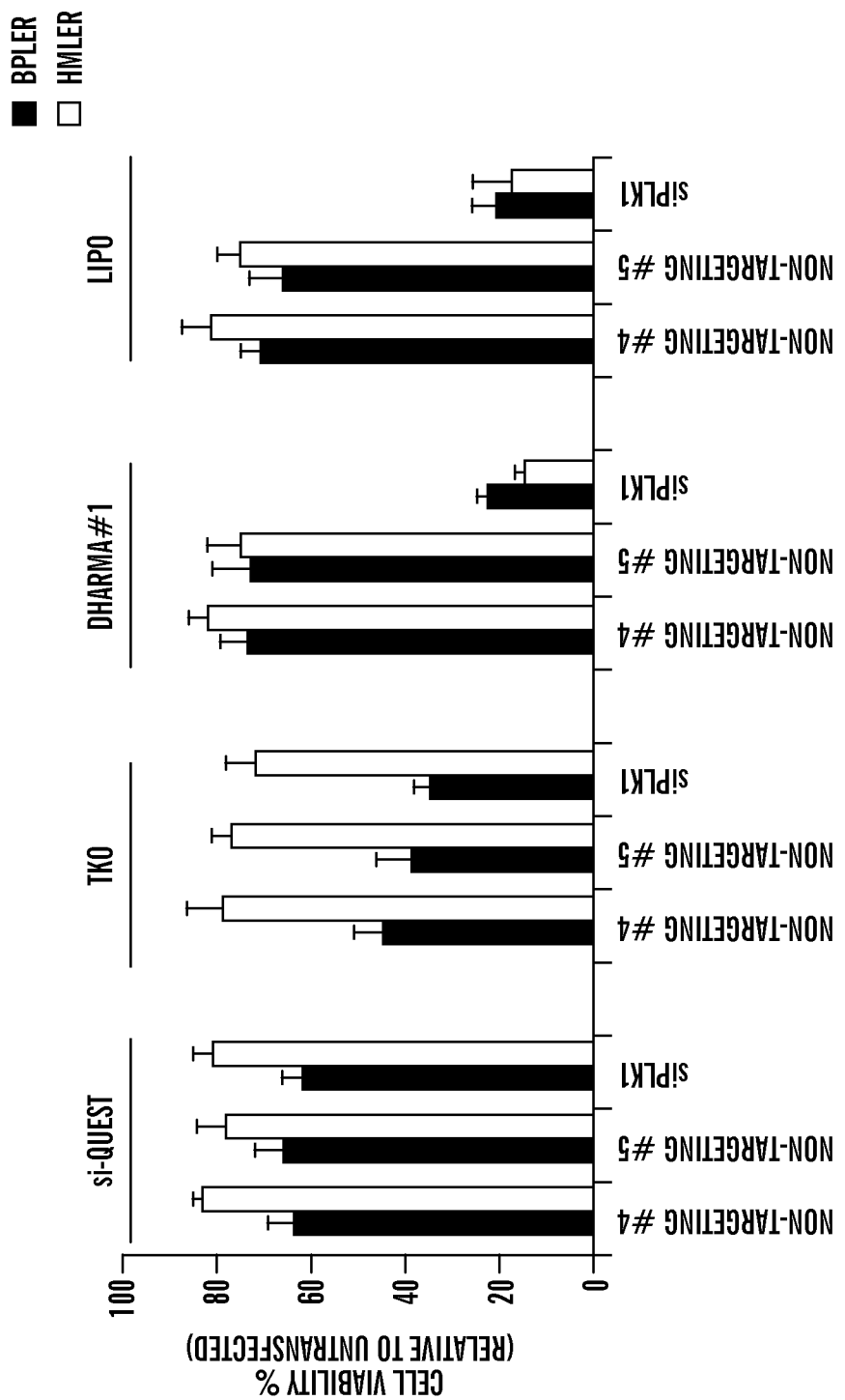
Figure 9C:
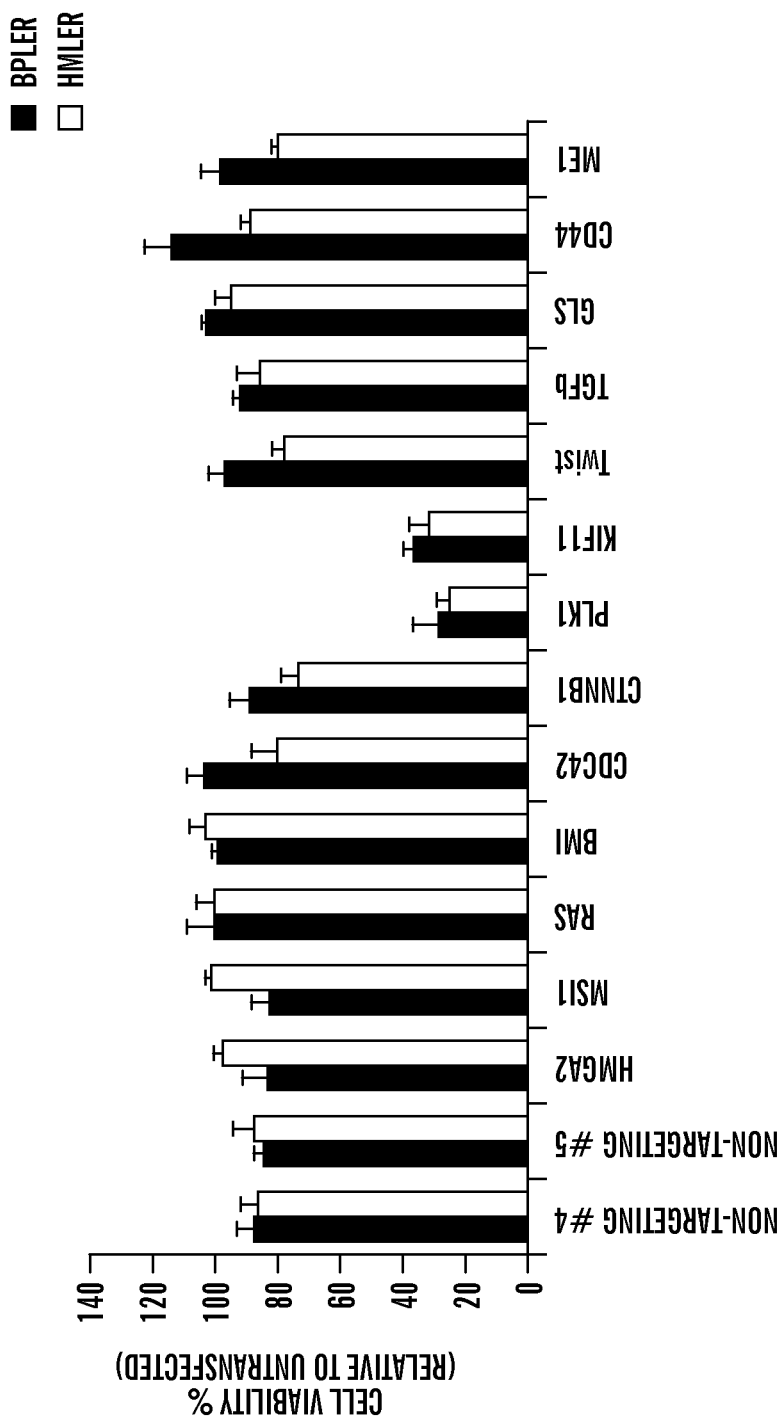
Figure 9D:
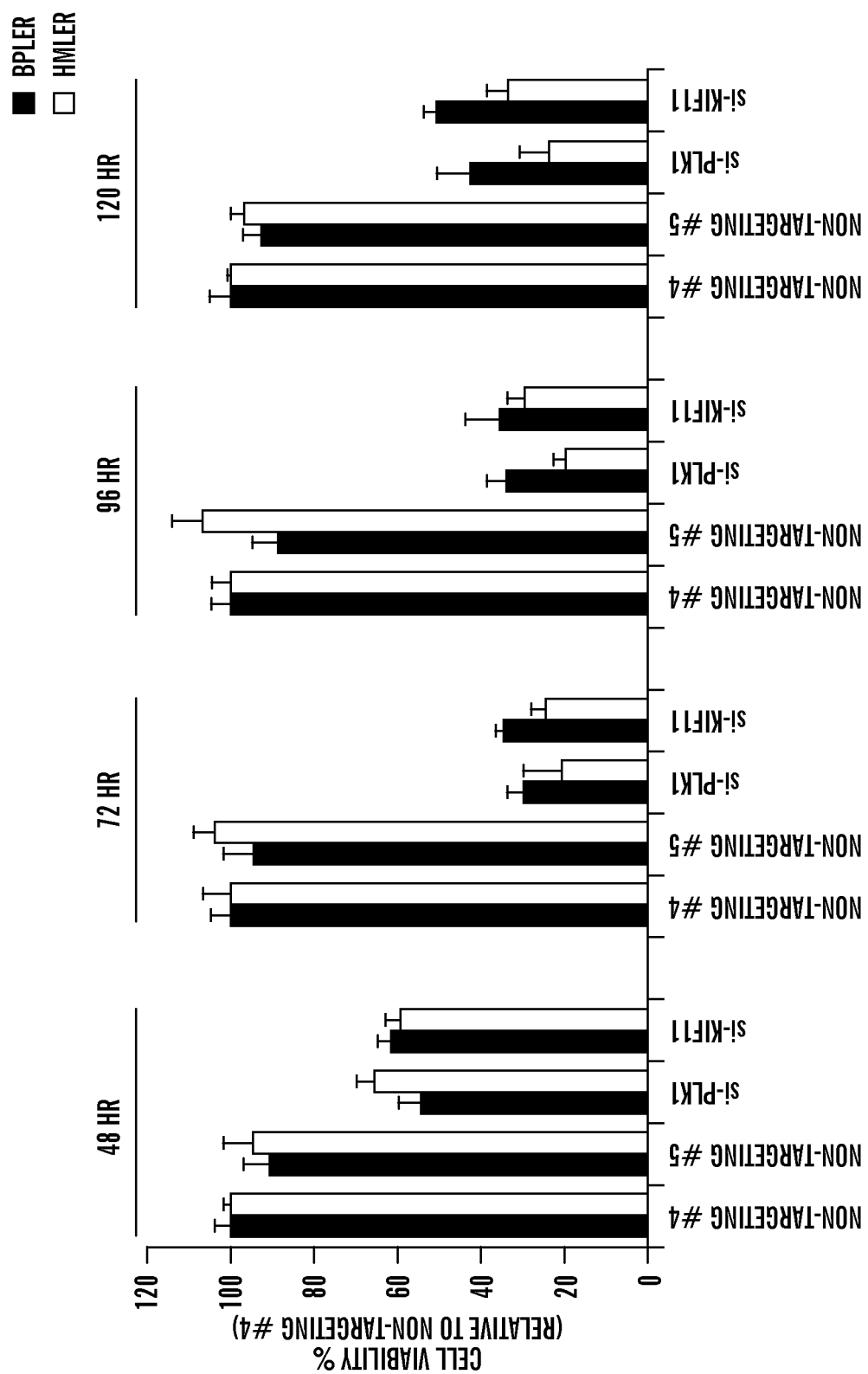
Figure 9E:
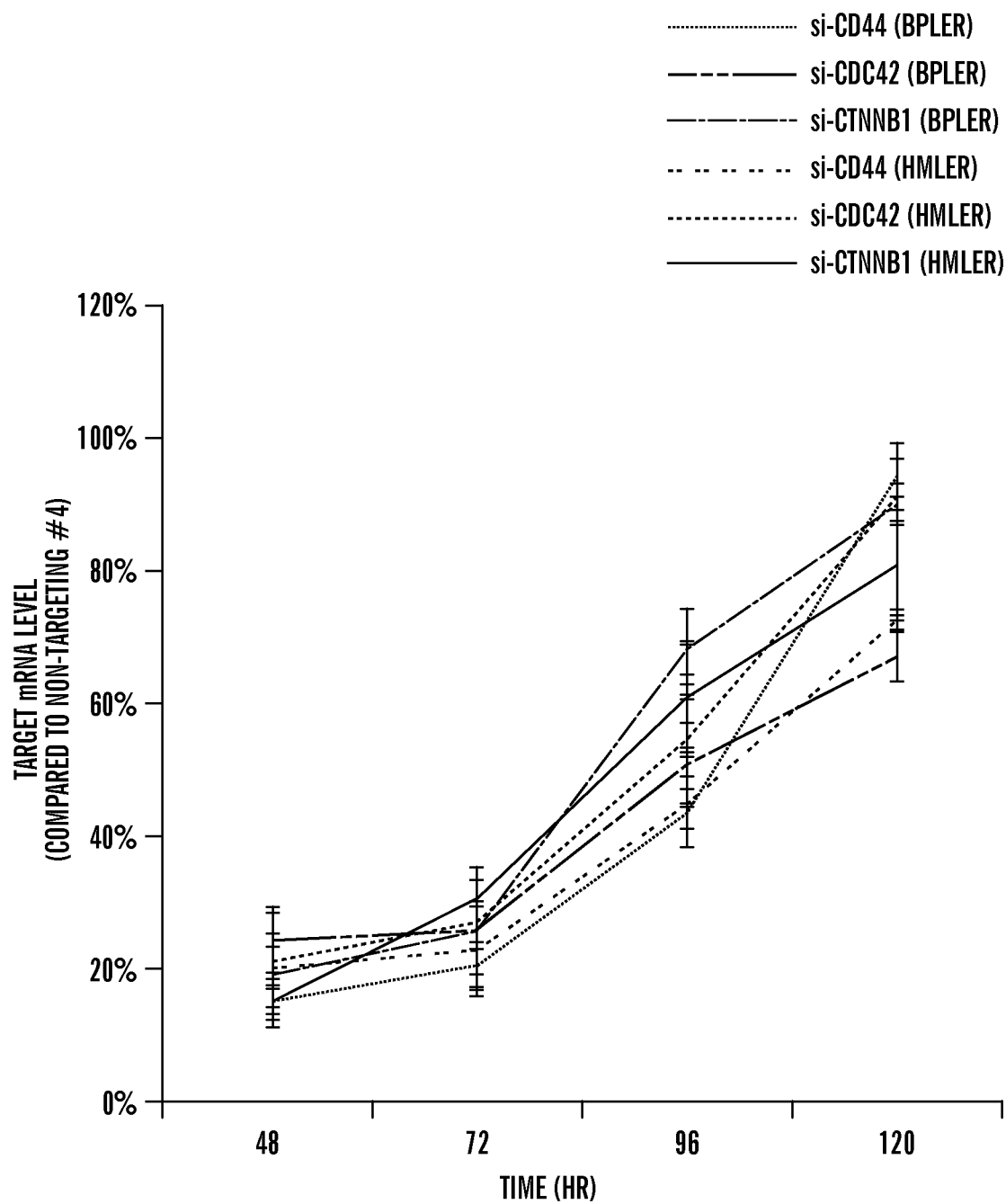
Figure 9F:
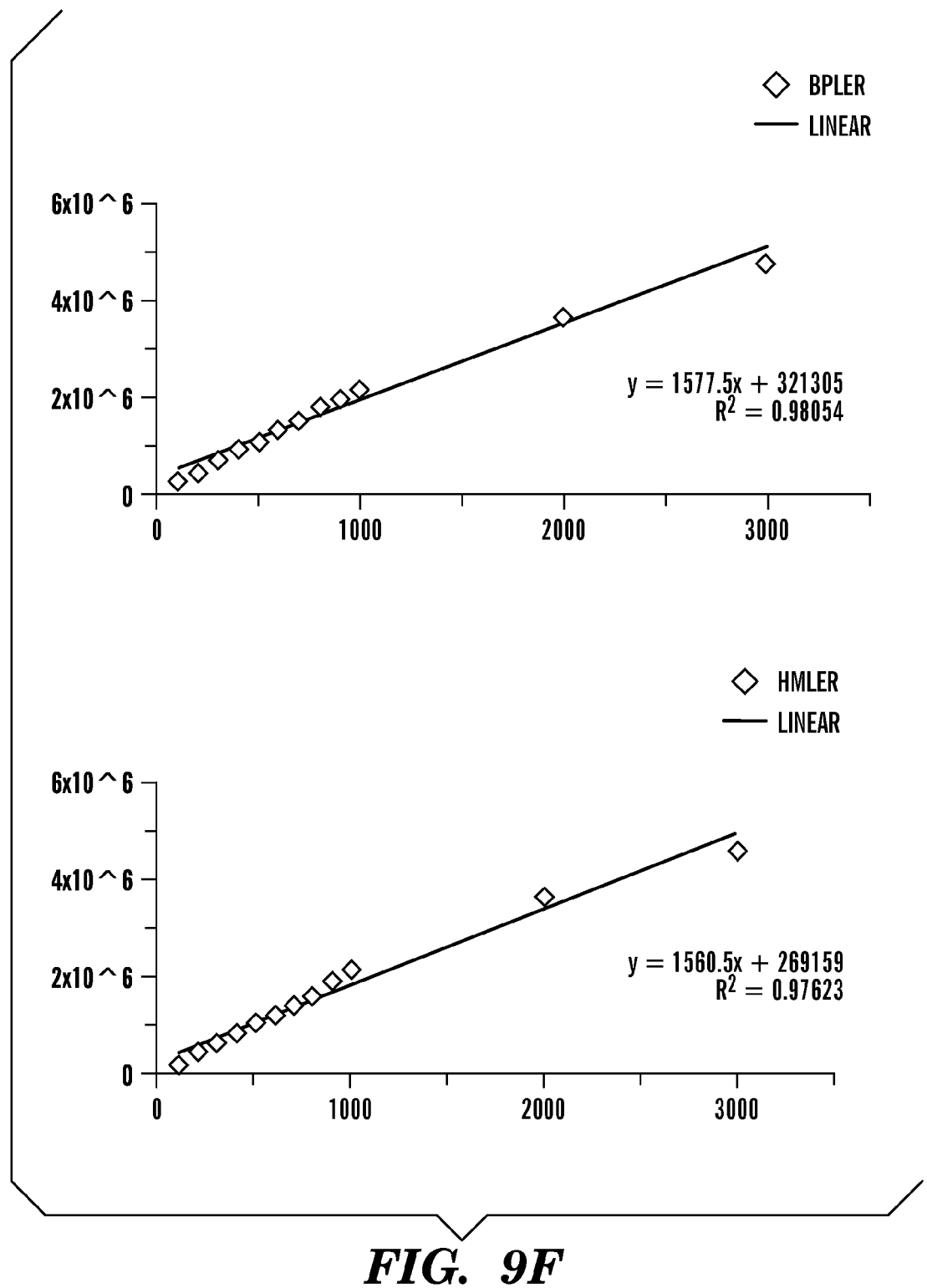
Figure 9G:
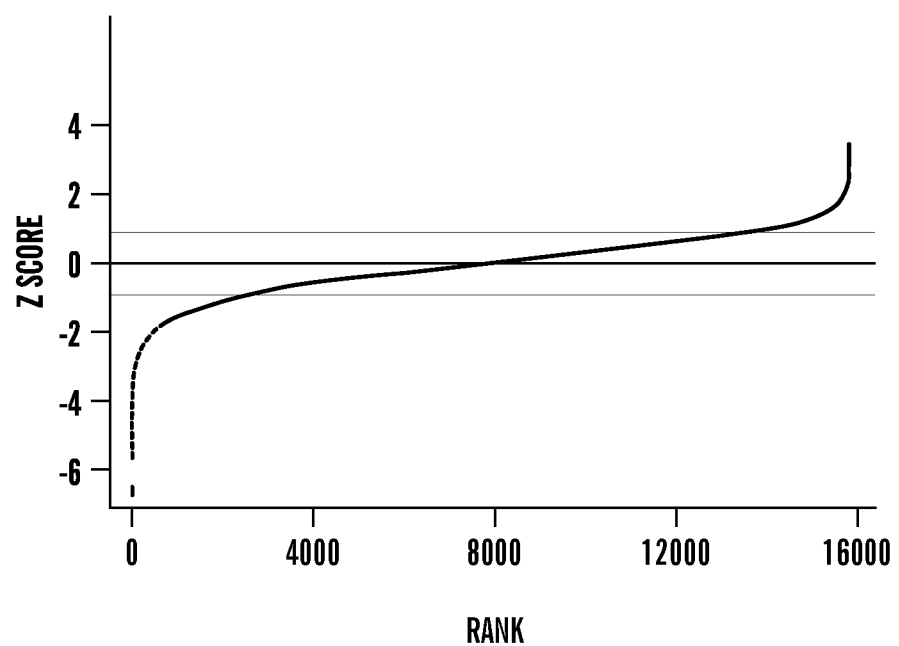

At least two types of breast epithelial cells, termed BPEC and HMEC cells, can be reproducibly derived from normal human breast organoids expanded in vitro using different chemically-defined media, WIT and MEGM, respectively[10] (FIG. 1A). BPEC have a progenitor-like phenotype, whereas HMEC have a myoepithelial-like phenotype. After transformation with hTERT, SV40 early region and H-RAS$^{V12}$ in these respective media, they give rise to BPLER and HMLER cancer cell lines. Because these cells are essentially genetically identical but differentially tumorigenic, they represent an attractive model to study epigenetic changes associated with tumor initiation. To exclude continuing contributions of the differences in the growth media to their tumor properties, we propagated both cell lines in WIT medium for two weeks before analyzing their phenotype, proliferation and tumor-forming capacity. (The phenotypic properties of the HMLER cell line once established did not change upon culture in WIT medium; therefore all subsequent experiments compared BPLER and HMLER cells both grown in WIT medium.) We first set out to determine whether either of these cell lines, which are both triple negative and EGFR+ (FIG. 1B), might be a good model for TNBC. Both BPLER and HMLER also stain with markers CD44+CD24$^{low/-}$ESA+ used to define breast tumor-initiating cells (BT-IC) (FIGS. 8A-8C). Although BPLER and HMLER cells proliferated at a similar rate in vitro (FIG. 1C), BPLER cells uniformly formed tumors in mice with as few as 50 cells, whereas $5 \times 10^4$ or fewer HMLER cells did not (FIG. 1D). Thus only BPLER are highly enriched for breast tumor-initiating cells (BT-IC). When more cells are injected, HMLER form squamous tumors that do not resemble any of the common breast cancer subtypes[10].

Figure 1E:
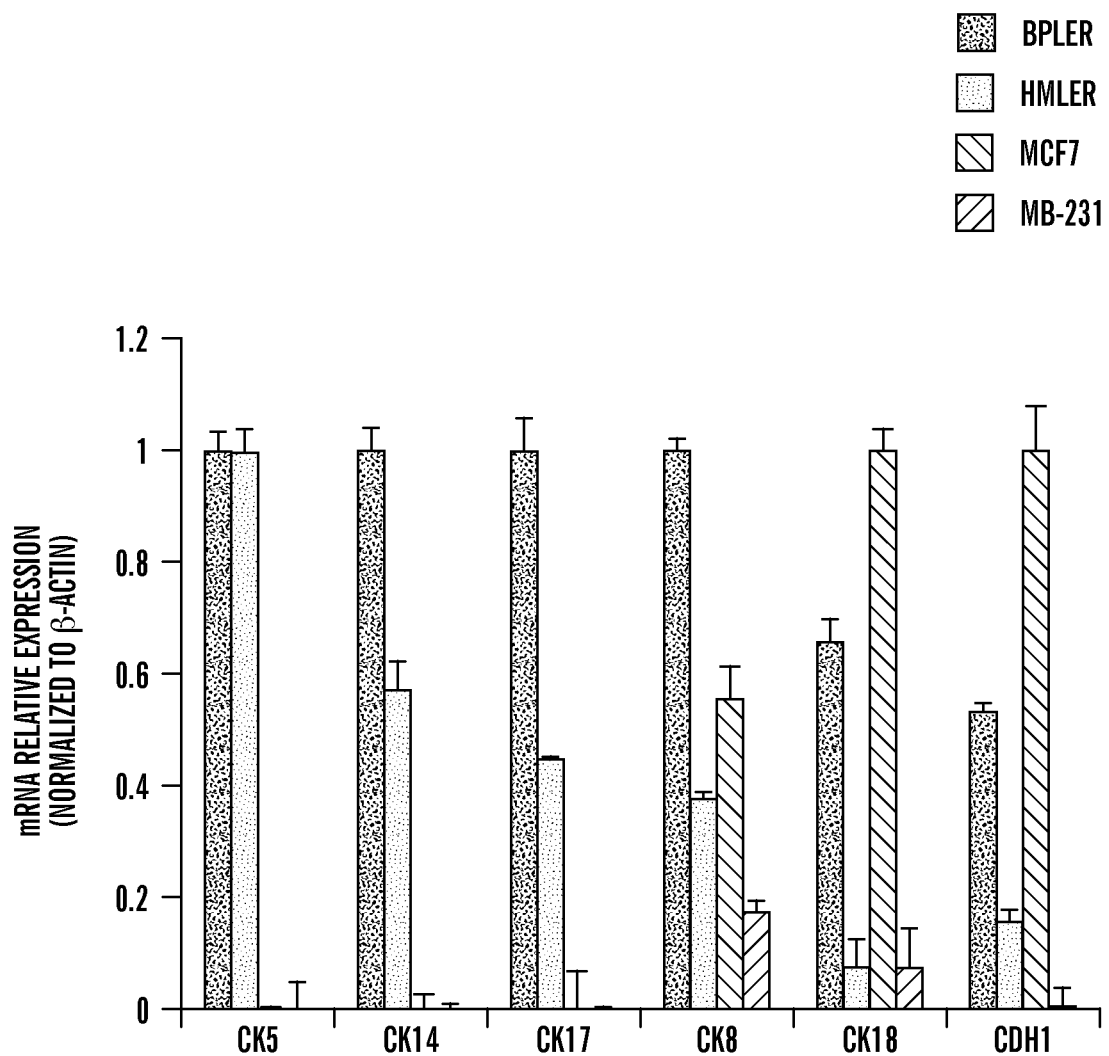

BPLER expressed a wide array of luminal and myoepithelial cytokeratin mRNAs, as is typical of TNBCs and untransformed bipotent epithelial progenitor cells, and intermediate levels of both E-cadherin and vimentin mRNAs, whereas HMLER cells had reduced expression of luminal cytokeratin and E-cadherin mRNA and expressed higher levels of vimentin mRNA (FIG. 1E, FIG. 8C). When examined by immunofluorescence microscopy, BPLER, but not HMLER, cells co-expressed CK14 and CK18 proteins, a property of mammary luminal epithelial progenitors[2]. Therefore, although both BPLER and HMLER cells were triple-negative and expressed cell surface markers that have been used to identify BT-IC, only BPLER cells had tumor-initiating potential and expressed markers of TNBCs and epithelial progenitors.

Next we asked whether tumors formed in vivo by subcutaneous injection of BPLER cells in immunodeficient mice resemble human primary TNBCs. BPLER tumor explants stained positive for CK5 and CK14 and negative for ER, had a high mitotic index and displayed a clear inflammatory infiltrate, reactive tumor stroma and pushing borders, all of which are typical of human TNBC[1,11]. Moreover, BPLER tumors were poorly differentiated epithelial lesions, with focal areas of glandular differentiation, consistent with their epithelial phenotype[10]. To examine more closely whether BPLER tumors resemble TNBCs, we compared by unsupervised hierarchical clustering the global transcriptional profile of six BPLER tumor explants that grew in either nude or NOD/SCID mice with mRNA expression profiles of 337 human primary breast tumors of known subtype (UNC337 dataset[12]). The BPLER tumor explants clustered with human primary TNBC and not with luminal A/B, normal-like or HER2+ subtypes. These findings were verified by analyzing an independent set of 7 normal breast samples and 40 human primary breast tumors (Richardson-06 dataset[13]), classified as basal-like or non-basal-like. BPLER again clustered with basal-like tumors, the most common gene expression subtype of TNBC. Thus, BPLER initiate tumors closely resembling human TNBCs and are a good model for studying TNBC.

A Genome-Wide siRNA Screen Identifies BPLER Survival Dependency Factors

Figures 2A, 2B:
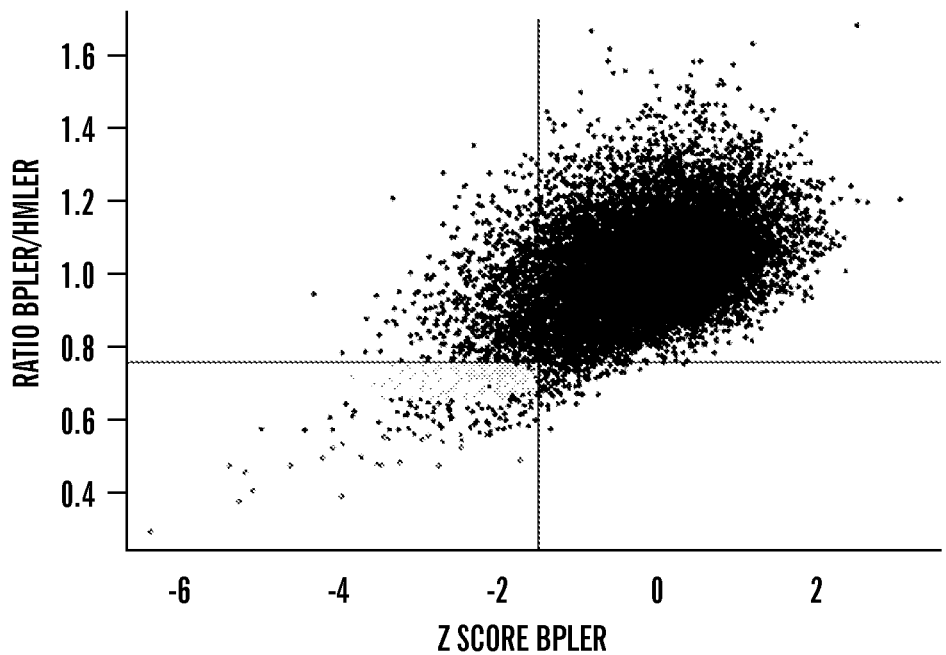

Although BPLER and HMLER are essentially genetically identical, they importantly differ in their differentiation state and ability to form tumors. To identify functional vulnerabilities associated with a TNBC-initiating phenotype, we performed a high throughput genome-wide siRNA lethality screen by transfecting BPLER and HMLER cell lines derived from the same donor in triplicate wells, each with a pool of 4 siRNAs targeting distinct sites within a single gene using the Dharmacon siGenome library of 17,378 gene targets (FIG. 2A). Three days later the mean number of surviving cells was assessed by CellTiterGlo assay and the ratio (R) of viable BPLER to viable HMLER cells was calculated. Data describing the optimization of the screen are described in FIGS. 9A-9G. The majority of the pools scored within one median absolute deviation (MAD) of the plate median. 1025 siRNA pools significantly decreased BPLER viability, of which 780 decreased HMLER viability to a similar extent (Table 1). Of the remaining 245 pools, 26 were highly selectively lethal for BPLER(R≤0.55), 76 were moderately selective (0.55<R≤0.65) and 143 were modestly selective (0.65<R≤0.75) (FIG. 2B, Tables 2A-2C). To validate the candidate hits (i.e. genes selectively required for BPLER survival), we next screened each of the hits by transfecting BPLER and HMLER cells separately with each of the four individual siRNAs comprising each pool. In the validation screen, 154 of the pools (63%) reconfirmed with at least one siRNA (Tables 2A-2C, FIG. 2B). Not surprisingly, the validation rates were higher for hits with lower R values (88% of highly selective, 75% of moderately selective and 52% of modestly selective hits were validated) (FIG. 2C).

Figure 2D:
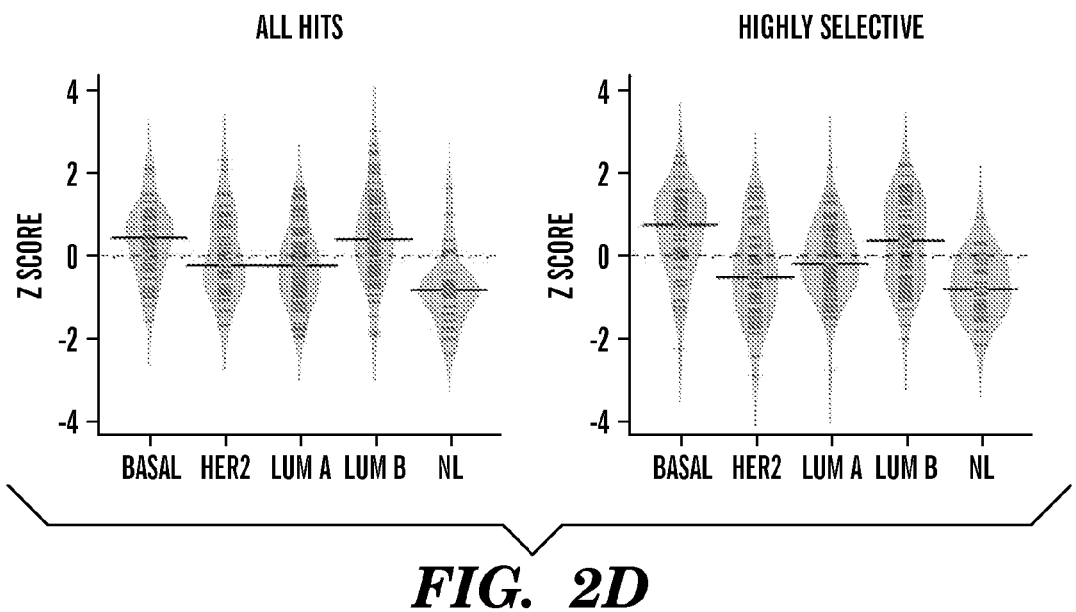
Figure 2E:
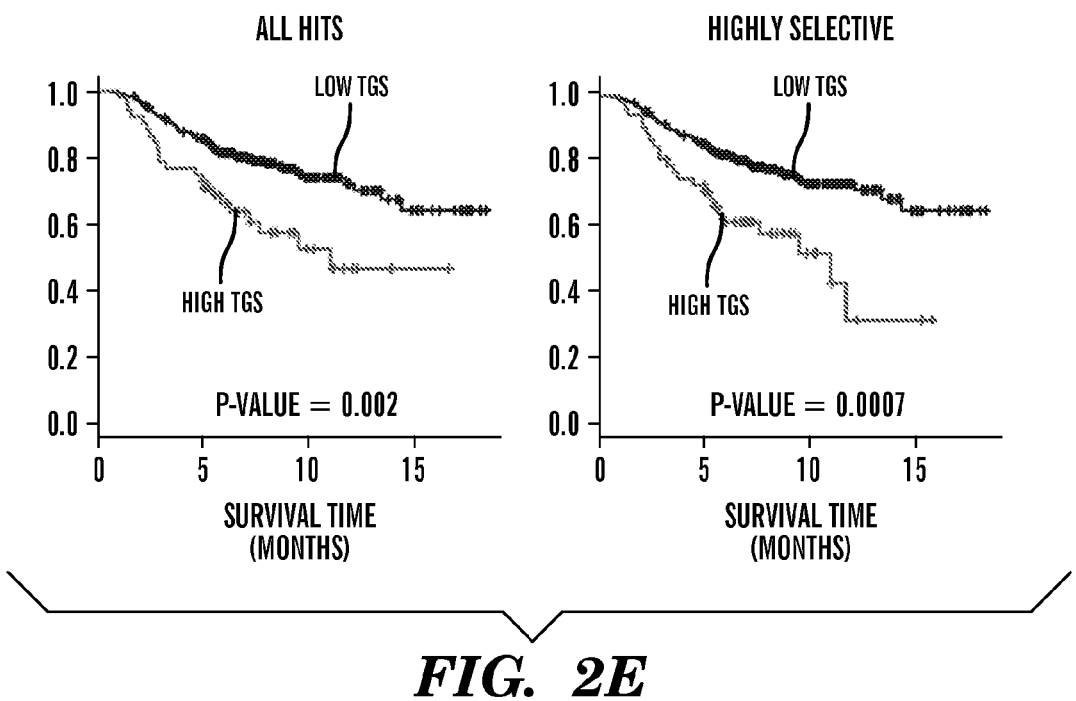
Figure 2F:
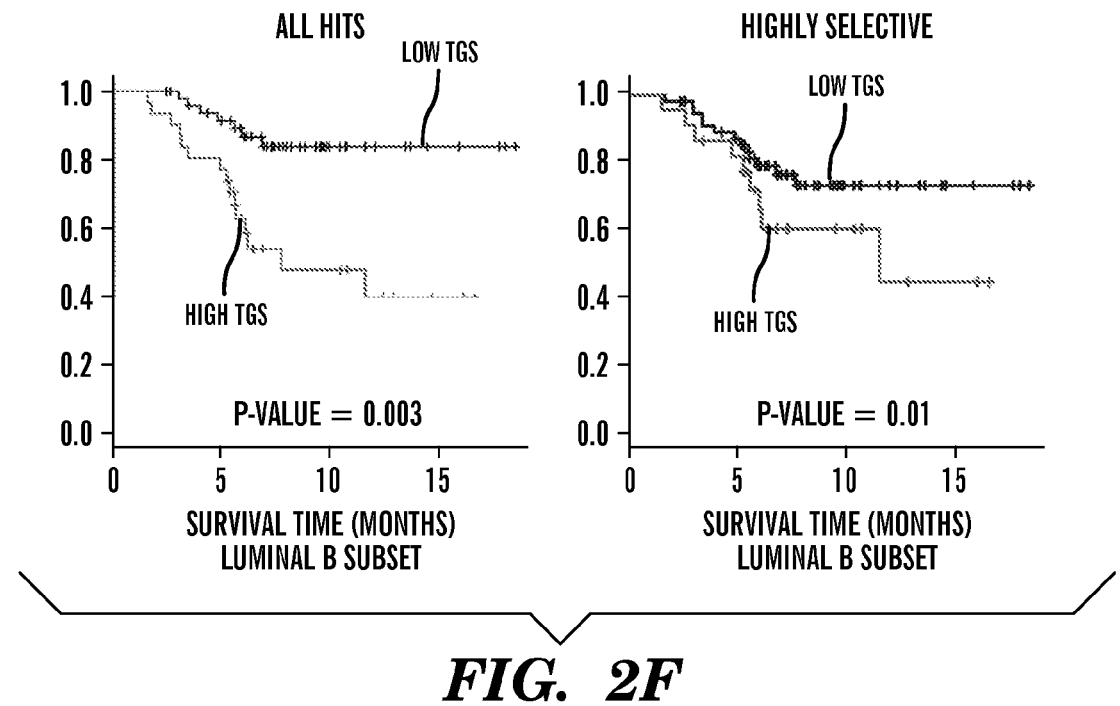
Figure 2G:
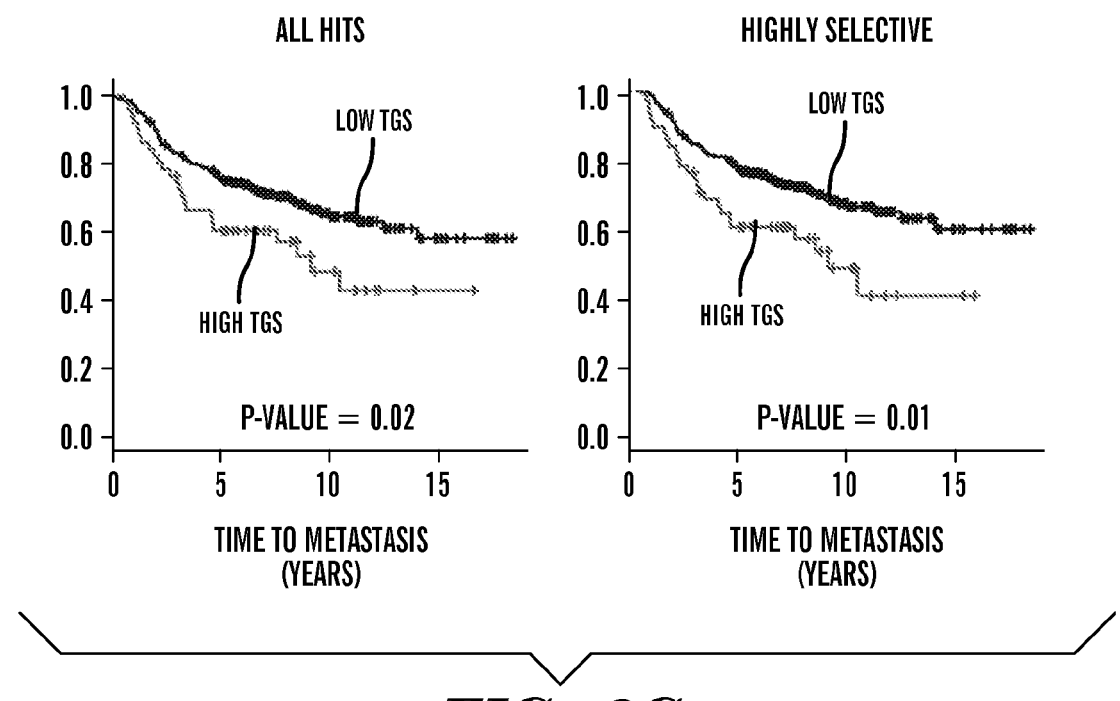
Figure 10:
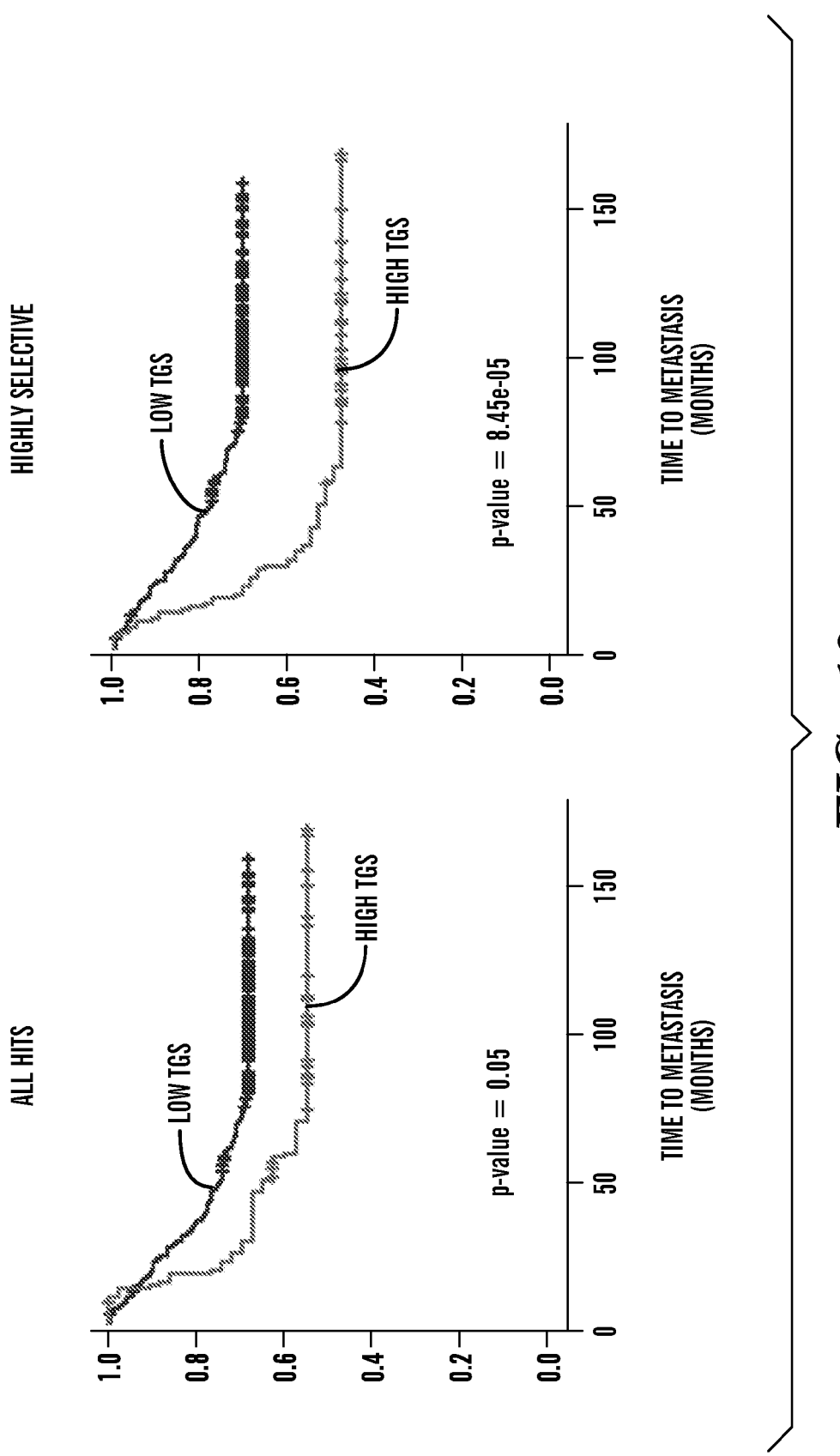
FIG. 10 demonstrates that enrichment of malignancy associated response signature genes in primary breast tumors predicts shorter metastasis-free survival. Kaplan-Meier curves depicting metastasis-free survival for breast cancer patients in the EMC286 dataset[15-16], showing shorter metastasis-free survival in patients with higher tumor expression of all malignancy associated response signature genes (left) or the highly selective subset (right). Patients from the EMC286 dataset were divided into two groups based on their tumor's GSEA enrichment score. High TGS tumors were defined by enrichment scores with p-value <0.1, and the remaining tumors were classified as low.

The BPLER Dependency Genes are Highly Expressed in TNBC and their Expression is Associated with Poor Prognosis in Breast Cancer To evaluate the clinical relevance of the 154 validated BPLER dependency genes, we examined the expression of this gene signature across breast cancer subtypes using the NKI mRNA expression profiles of 295 primary breast cancers, classified as basal-like, HER2+, luminal A, luminal B, or normal-like[14]. The dependency genes were significantly over-expressed in both basal-like and luminal B tumors relative to other subtypes (p-value $<3\times10^{-5}$ and $4\times10^{-6}$, respectively, by Kolmogorov-Smirnov (KS) test). When the analysis was limited to the 23 highly selective gene hits, the same two subtypes significantly overexpressed these genes ($p<3\times10^{-6}$ and $4\times10^{-5}$) (FIG. 2D). To determine whether overexpression of these genes might correlate with clinical prognosis, we divided the NKI tumors into two groups based on their expression of either the 154 or the subset of 23 highly selective BPLER dependency genes. In both cases, patients with high expression of the dependency genes had significantly reduced survival. The survival difference was significantly greater if the analysis were restricted to the highly selective hits (FIG. 2E). Because high expression of the 154 BPLER dependency genes is linked to TNBC and to poor prognosis, we consider the 154 genes a malignancy associated response signature (MARS) or TNBC gene signature (TGS). Luminal B tumors, which comprise ~15% of human breast tumors, have variable prognosis. Within this category, expression of the TGS or highly selective hits clearly separated luminal B tumor patients with poor survival (p<0.003 and p<0.01, respectively), indicating that the MARS is enriched in highly malignant breast tumors, independently of tumor subtype (FIG. 2F). Indeed, it can be used to predict prognosis in luminal B tumor patients. Within the NKI dataset, patients with higher MARS or highly selective hit expression also were diagnosed with metastasis significantly earlier than patients with low MARS expression (FIG. 2G). A highly significant association of low MARS expression with metastasis-free survival was also found by analyzing an independent dataset of 286 primary breast tumors (EMC286 dataset[15,16], FIG. 10). In conclusion, BPLER dependency genes are more highly expressed in highly malignant human primary breast cancers, and might serve as therapeutic targets against TNBC.

BPLER Dependency Genes are Enriched for Proteasome Subunits and Genes Involved in Mitosis, Metabolism, DNA Transcription and RNA Biogenesis An examination of the 23 validated highly selective BPLER dependency genes (FIG. 2C) indicated to us that BPLER cells might be selectively dependent on proteasome function since 7 of these genes are proteasome components (hypergeometric p-value $1.1\times10^{-14}$) and an additional hit (UBL5) encodes for a ubiquitin-like molecule. Another group of 4 genes is involved in mRNA biogenesis and nuclear export. These included the spliceosome component PRPF8 and 2 RNA helicases (DDX19B, DHX8) and the nuclear RAS protein RAN, all involved in mRNA nuclear export. In addition the hit list contained 4 Zinc finger genes (ZNF490, ZNF574, ZNF643, FIZ1), all likely transcriptional activators, and a nuclear receptor coactivator gene SNW1 associated with activation of retinoic acid and estrogen-regulated genes. Also of note were 2 genes RACGAP1 and HAUS3 that regulate the mitotic spindle and PP2CA, the gene encoding the catalytic subunit of the tumor suppressor PP2A that modulates the action of many oncogenic protein kinases.

To begin to make sense of the larger 154 member MARS, we first looked at whether the hits could be grouped into well-defined functional categories, using a combination of the pathways and processes in the Reactome[17], KEGG[18] and Wikipathway[19] databases. Of the 154 MARS genes, 121 genes have well described annotations that could be grouped into 13 functions with at least 3 genes assigned to each function (Table 4A). The proteasome was highly overrepresented in the MARShit list with 10 proteasome subunits)($p<3\times10^{-10}$ and 6 other genes whose products participate in the UPS system. Of these, 5 genes are involved in ubiquitylation, including 2 components of the anaphase promoting complex (APC; ANAPC2, ANAPC4), and one gene is involved in neddylation of the cullins (NEDD8) to promote mitosis.

We next used GeneMANIA[20] to build an interaction network relating the MARS set incorporating physical and predicted interactions, co-localization, shared pathways and shared protein domains. 87 genes in the MARS set formed a single interacting network. Genes that participate in the major functional categories, but are not annotated to have direct protein interactions, were added to this network to produce a core functional-interaction module (FIG. 3). Notably, the proteasome and its associated proteins constituted a core module linking multiple TGS genes. Other broad processes that stood out were metabolism, which included genes encoding 2 glycolytic enzymes (GAPDH, PFKL), the G1/S transition and mitosis steps of the cell cycle and multiple steps in mRNA expression, since the MARS captured multiple DNA binding proteins expected to regulate transcription, several RNA polymerases and genes involved in mRNA splicing.

Highly Malignant TNBC Epithelial Cells are Selectively Addicted to Proteasome Activity One of the goals of the screen was to point to potential therapeutic approaches for TNBC. Since the proteasome is a key module in the MARS and proteasome inhibitors are available in the clinic, we first evaluated the effect of proteasome inhibitors on BPLER and other breast cancer lines.

Figure 4A:
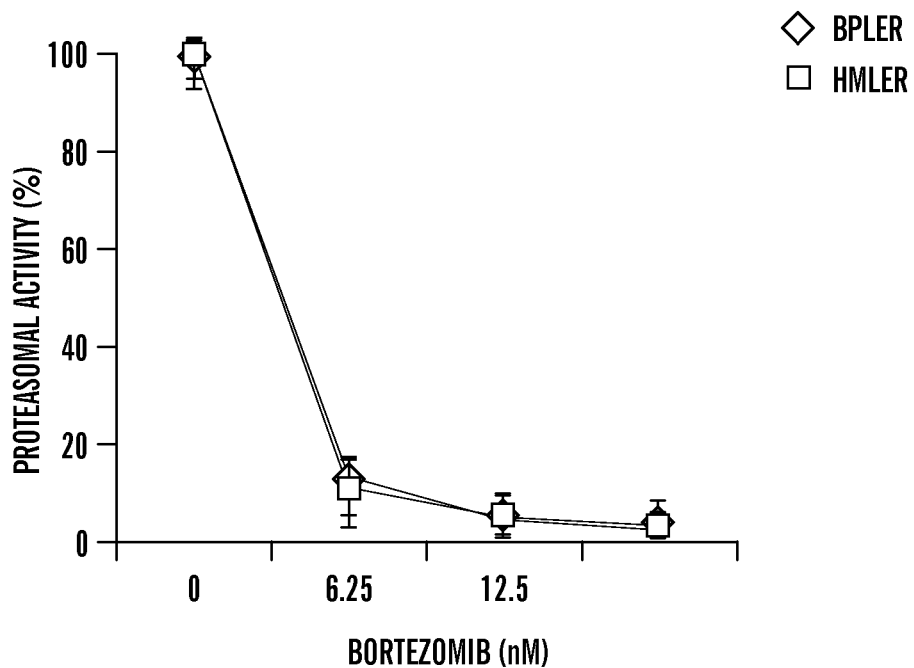
FIGS. 4A-4H demonstrate that Epithelial TNBC cells are selectively sensitive to proteasome inhibitor drugs. (4A) Proteasome activity in BPLER and HMLER 6 hr after treatment with the indicated dose of bortezomib, as determined by ProteaGlo assay. At this time most cells are viable. (4B-4C) Viability of BPLER and HMLER cells, 24 hr after treatment with the indicated doses of bortezomib (4B) or doxorubicin (4C). (4D) Propidium iodide DNA staining showing accumulation of tetraploid cells (BPE and HMLER) or subdiploid cells (BPLER) 24 hours after treatment with bortezomib (12.5 nM). (4E) Immunoblot of lysates treated with bortezomib at the indicated dose for 24 hr. Each sample was assessed in duplicate independent samples. (4F) Viability of normal breast epithelial cells (BPE), ER+ (MCF7), HER2+ (BT-474), mesenchymal (MDA-MB-231, MDA-MB-436) or epithelial TNBC (4T1-E, BPLER, HCC-1143, HCC-1937) cells treated for 24 hr with bortezomib (12.5 nM) relative to vehicle control, as assessed by CellTiterGlo. (4G) Colony assay of HCC-1143 and 4T1-E cells treated with bortezomib (12.5 nM) for 18 hours and cultured for 2 weeks in drug-free medium. (4H) Tumorigenicity assay of 4T1-E cells treated with bortezomib (12.5 nM) or DMSO for 18 hours in vitro and injected orthotopically in the mammary fat-pad of Balb/c mice.
Figure 4B:
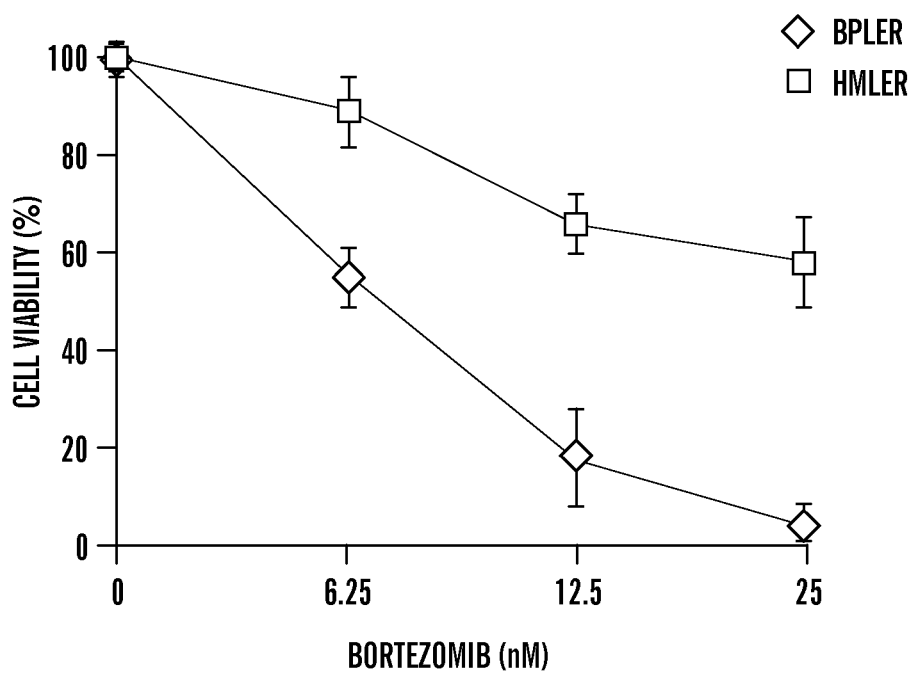
Figure 4C:
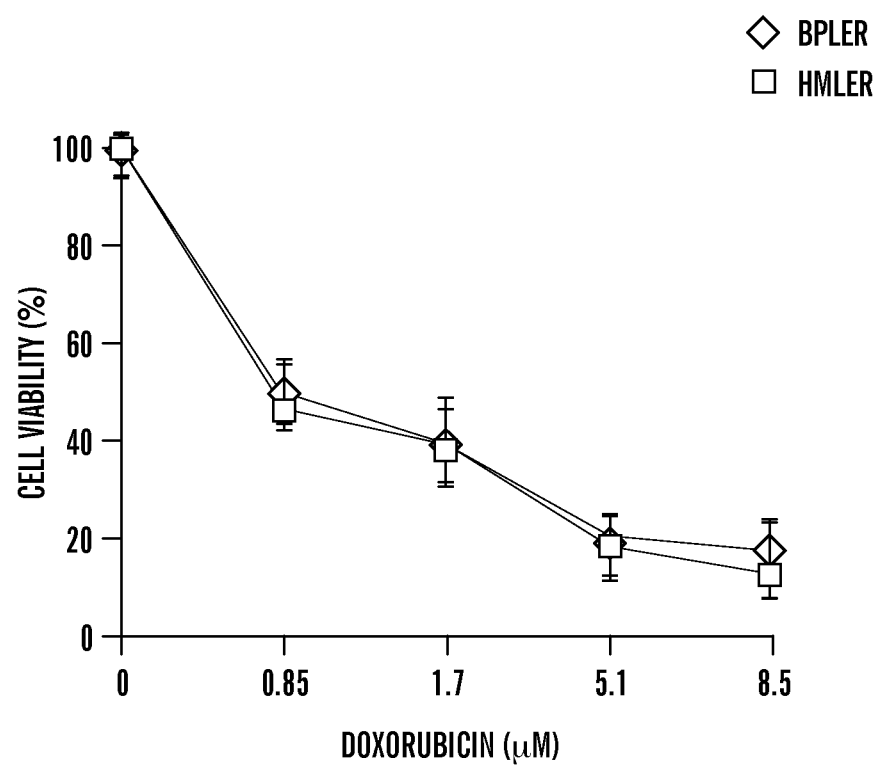
Figures 11A, 11B:
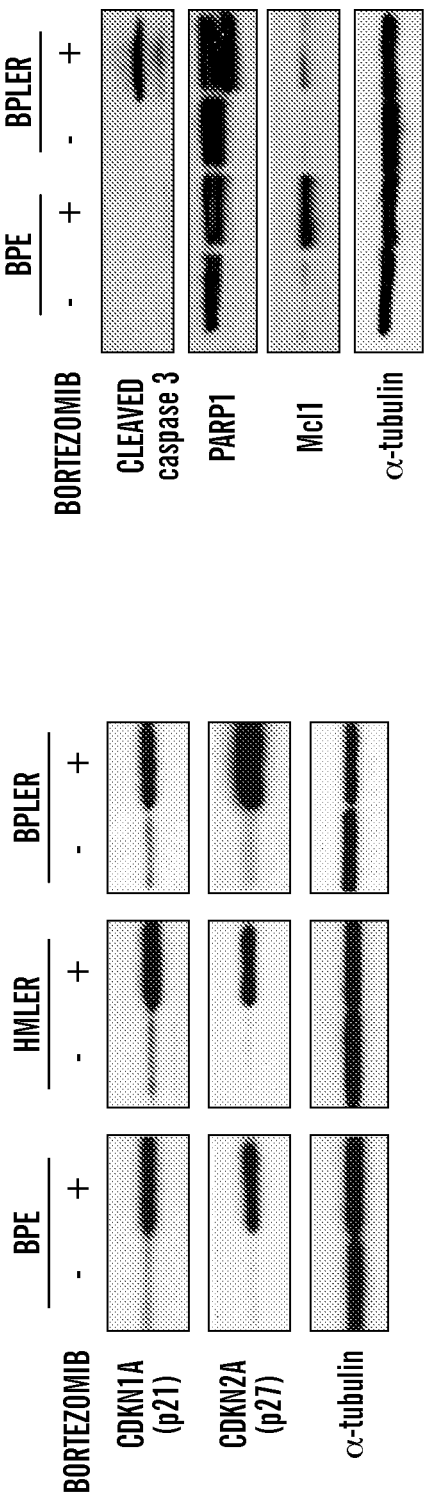
FIGS. 11A-11C demonstrate BPLER cells are selectively sensitive to proteasome inhibitor drugs. (11A) Immunoblot analysis of protein lysates from BPE, HMLER and BPLER 24 hours after treatment with bortezomib (12.5 nM) or DMSO showing similar induction of proteasome-regulated genes. (11B) Immunoblot of lysates from BPE cells treated with bortezomib (12.5 nM) for 24 hr. BPLER were used as control. (11C) Flow cytometry analysis of Annexin V/Propidium Iodide (PI) staining of BPE, BPLER or HMLER treated with bortezomib (12.5 nM) and/or zVAD-fmk (20 µM) for 24 hr. The percentage of double-positive cells is indicated.

The proteasome inhibitor bortezomib similarly inhibited proteasome activity (FIG. 4A) and induced accumulation of p21 and p27 proteins, two established biological markers of proteasome inhibition, in BPLER and HMLER (FIG. 11A). However, as anticipated, BPLER were more sensitive to bortezomib compared to HMLER (FIG. 4B). Similar results were obtained using MG132 and second-generation proteasome inhibitor drugs. The sensitivity of BPLER cells to bortezomib was specific, since BPLER and HMLER cells responded similarly to treatment with doxorubicin (FIG. 4C).

Figure 4D:
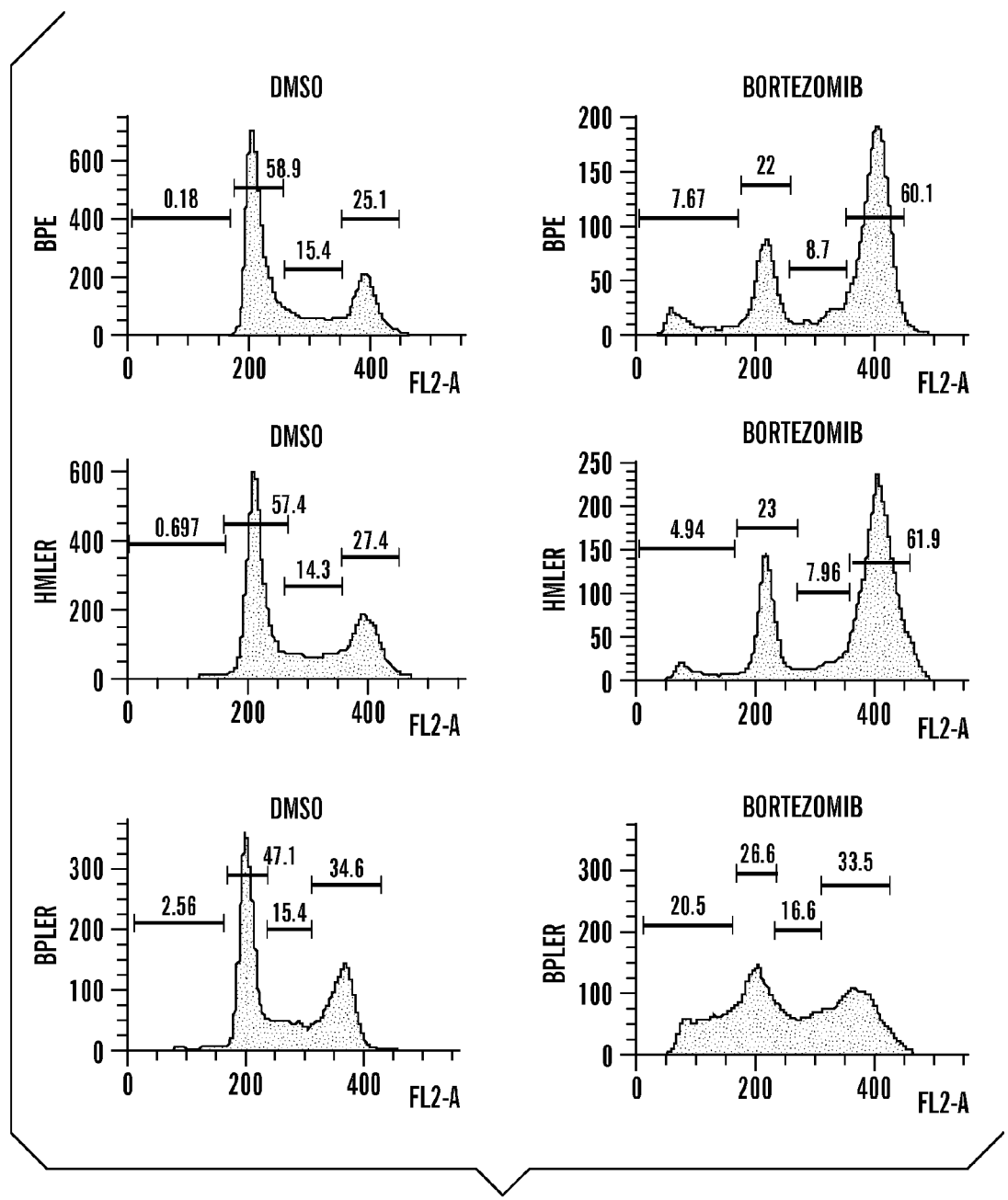
Figure 4E:
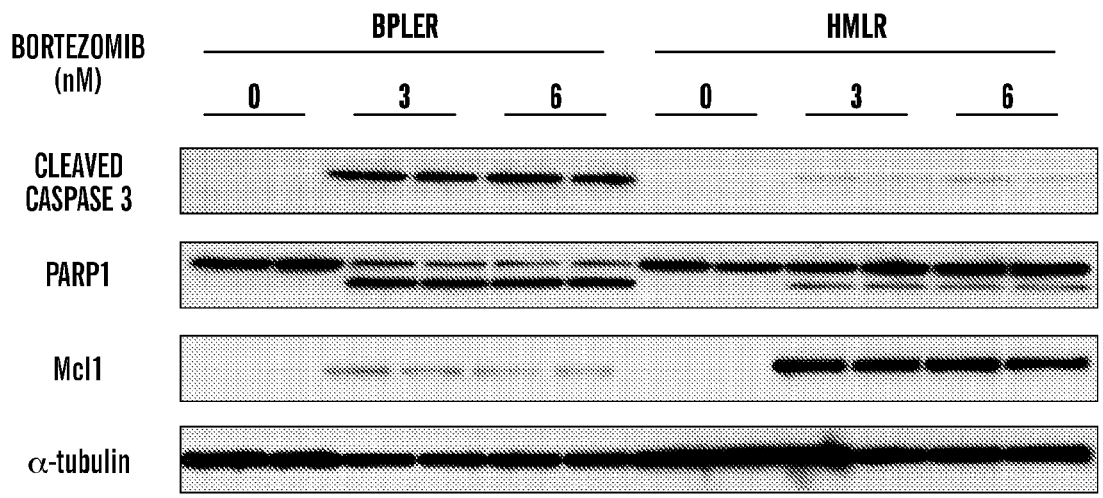

After low-dose bortezomib treatment, BPLER did not undergo cell cycle arrest and showed clear evidence of DNA fragmentation, caspase-3 activation, and PARP1/Mcl-1 cleavage, suggesting that they died of apoptosis, whereas HMLER underwent G2/M arrest with minimal signs of apoptosis. Notably, untransformed BPE underwent G2/M arrest and were resistant to bortezomib-induced apoptosis. Thus, bortezomib was not cytotoxic at this dose (FIG. 4D-4E, and FIG. 11B). This was confirmed by flow cytometry after annexin V and propidium iodide (PI) staining.

Figure 11C:
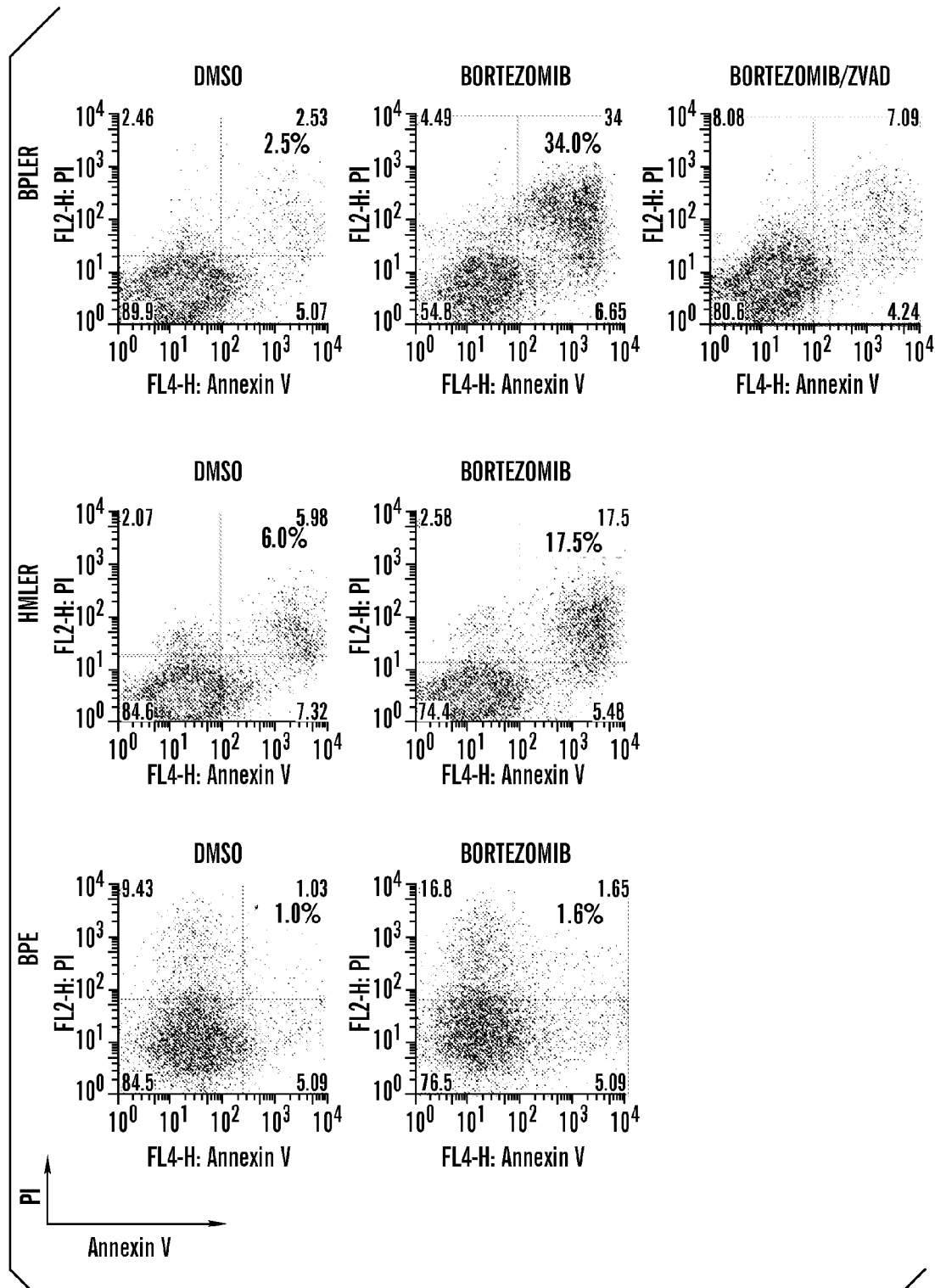

Moreover, BPLER developed an annexin V+PI+ population that mostly disappeared after treatment in the presence of the pan-caspase inhibitor zVAD-fmk, confirming the induction of caspase-dependent cell death by proteasome inhibition (FIG. 11C).

Figure 4F:
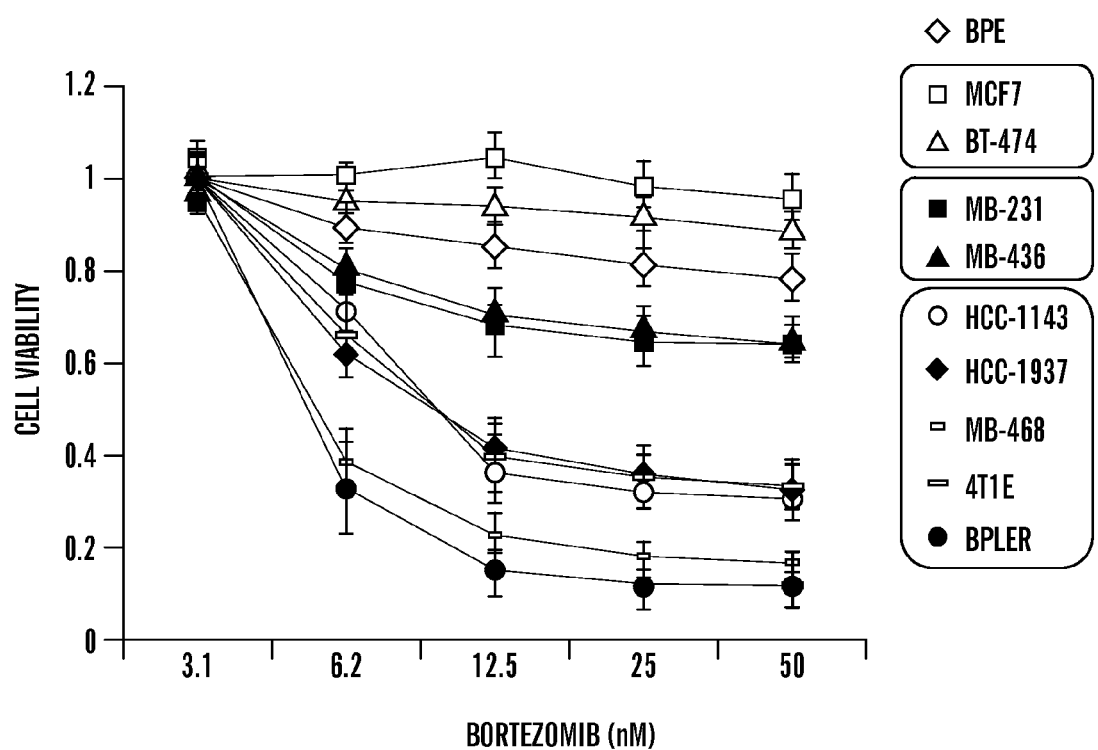
Figure 4G:
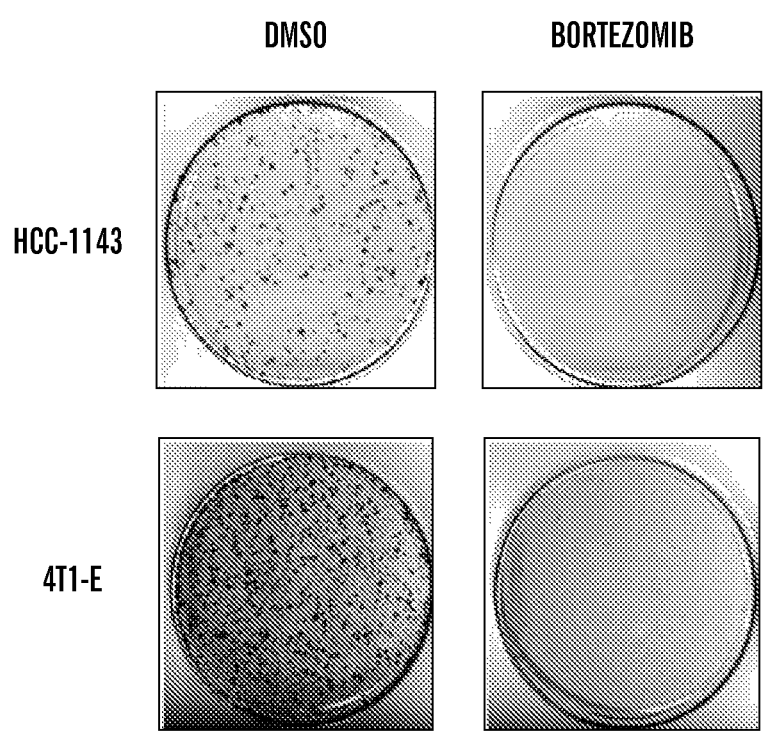
Figure 4H:
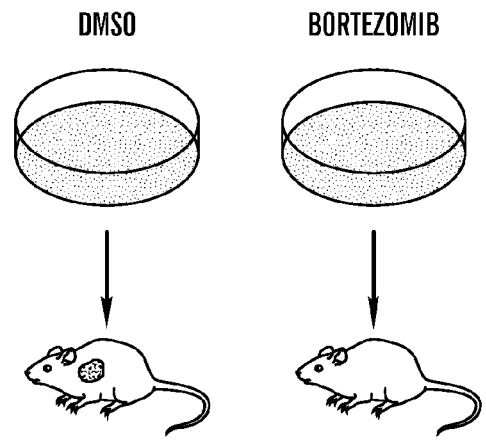
Figure 4H:
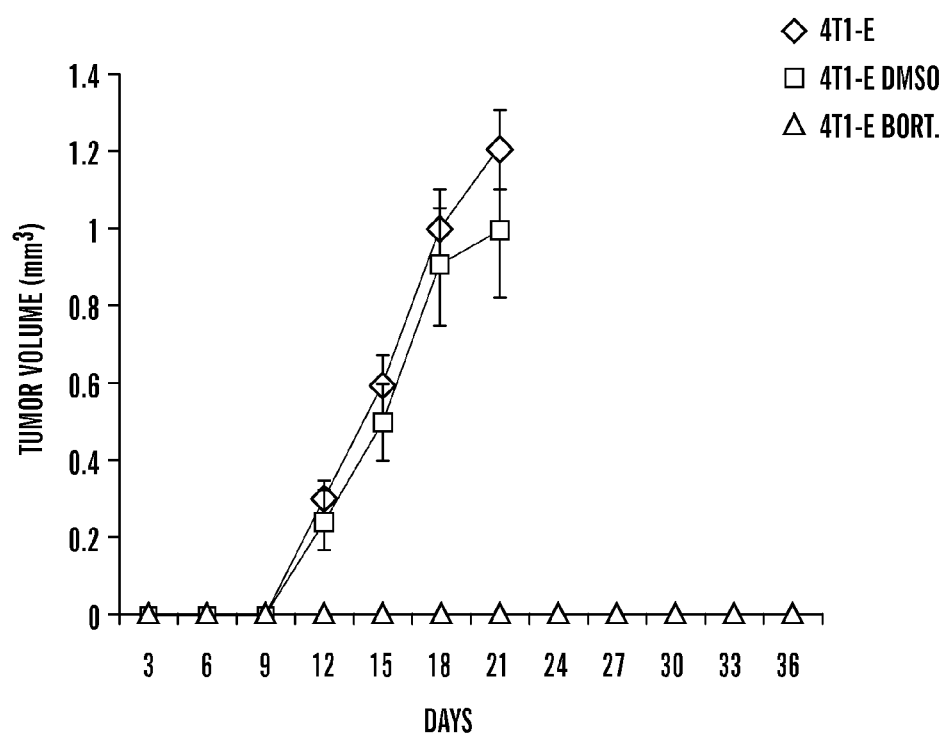

Four other epithelial TNBC cells (MB-468, HCC-1143, HCC-1937 and 4T1-E) were also relatively sensitive to bortezomib, whereas ER+(MCF7), HER2+ (BT-474) and mesenchymal (MB-231, MB-436) breast cancer cell lines were resistant, suggesting that TNBC epithelial cell lines are selectively addicted to proteasome activity (FIG. 4F). In the highly malignant 4T1-E breast cancer cell line, viable cells that persisted after 18-hour bortezomib treatment neither formed colonies in vitro after 2 weeks, nor were able to initiate tumors in vivo. Similar results were obtained in HCC-1143 in vitro (FIGS. 4G-4H).

Together, these data indicate that TNBC epithelial cells with tumor-initiating potential are exquisitely sensitive to proteasome inhibition.

Noxa Mediates Bortezomib-Induced Apoptosis in Epithelial TNBC Cell Lines.

Figure 5A:
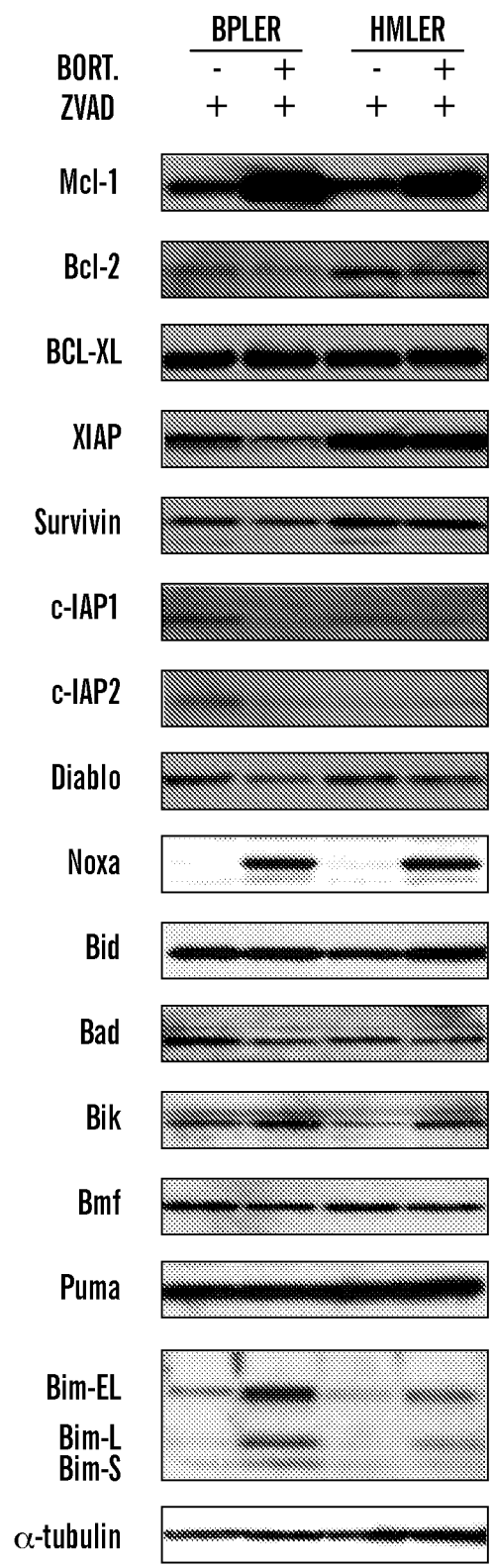
FIGS. 5A-5H demonstrate Bortezomib targets Mcl-1 dependency in TNBC through induction of Noxa. (5A) Immunoblot analysis of protein lysates from BPLER and HMLER treated with bortezomib (12.5 nM) or DMSO for 24 hours in the presence of ZVAD-fmk (20 uM). (5B) Representative DilC1(5) staining of BPLER and HMLER treated with bortezomib (12.5 nM) for 18 hours, as determined by flow cytometry. CCCP was used as positive control. The graph (right) shows median intensity value of DilC1(5) staining +/−SD from 3 independent experiments. (5C) Cell viability of BPLER cells 48 hours after transfection with siRNAs (50 nM) against the indicated genes and treated with bortezomib (12.5 nM) or DMSO for 24 hours. Data for each siRNA are normalized to 1. (5D) Baseline levels of Noxa mRNA, relative to ACTB, by qRT-PCR in normal breast epithelial cells at different stages of transformation (BPE, BPLE, BPLER (FIG. 1A)) and in breast cancer cell lines of indicated subtype. (5E) Immunoblot of protein lysates from MCF7 (luminal) and HCC-1143 or HCC-1937 (TNBC) breast cancer cells treated with bortezomib (12.5 nM) for 24 hr. (5F) Immunoblot of protein lysates from BPLER or HMLER treated with bortezomib (12.5 nM) or DMSO for 24 hours in the presence of ZVAD and immunoprecipitated with antibodies against Mcl-1 or Bcl-XL or rabbit IgG, showing similar and specific Mcl1/Noxa binding in BPLER and HMLER. (5G-5H) Cell viability of human breast cancer cell lines of different subtype 48 hours after transfection with siRNAs (50 nM) against the indicated genes or non-targeting siRNA (control). Data in (5B, 5C, 5D, 5G, 5H) represent the mean+/−SD of 3 replicates. All data are representative of at least 3 independent experiments.
Figure 5B:
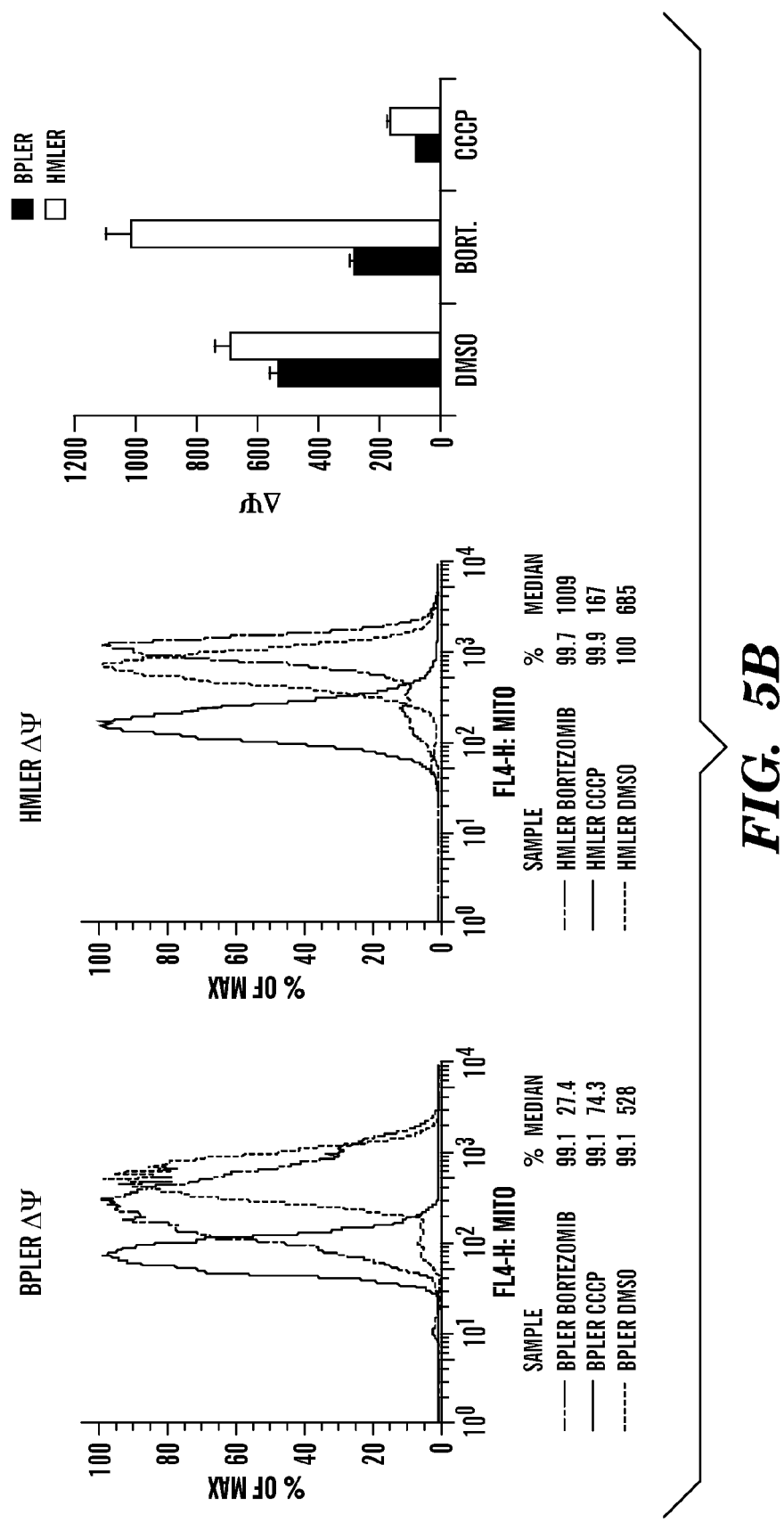
Figure 5C:
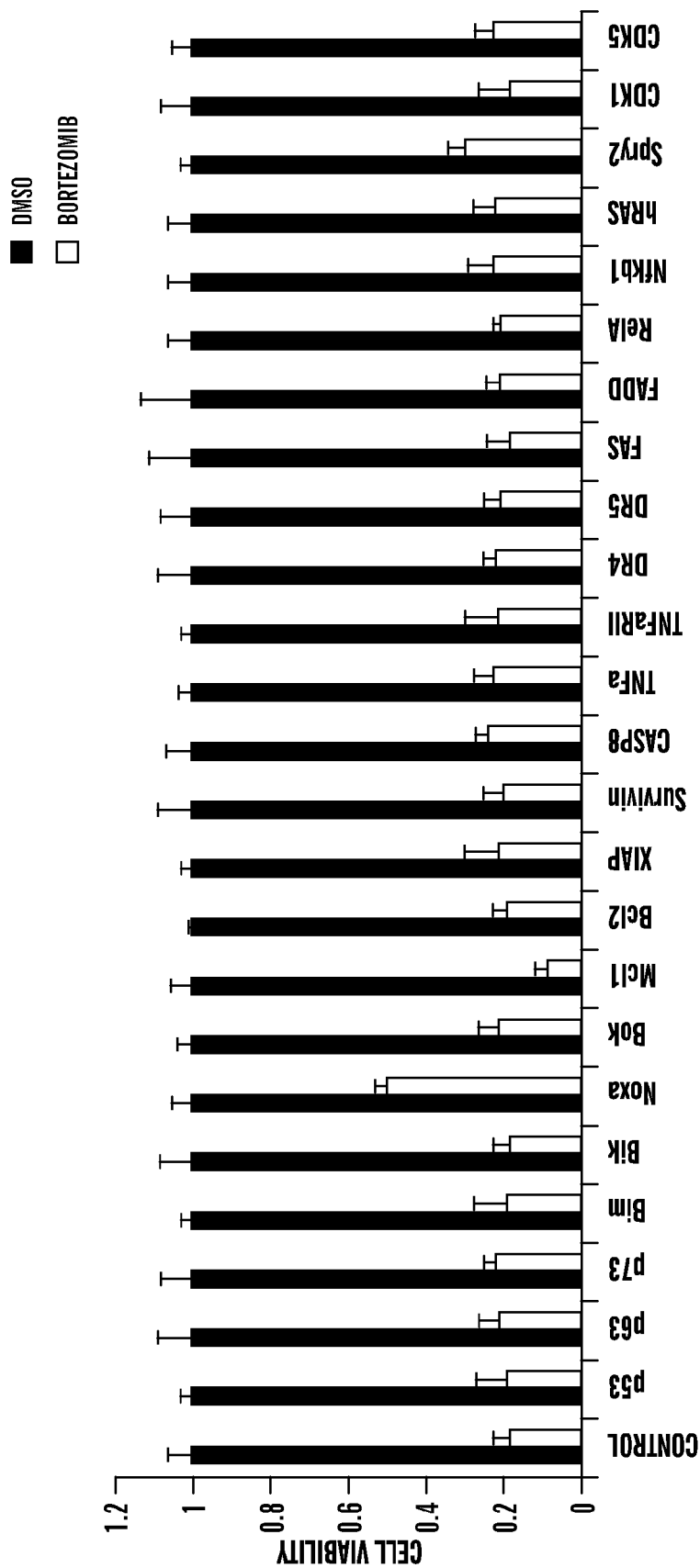

Because the proteasome was so prominent in the MARS and bortezomib was selectively lethal to highly malignant TNBC epithelial cells, we wanted to understand better the mechanism underlying BPLER and TNBC sensitivity to proteasome inhibition. Toward this goal, we first assessed the relative protein level of key modulators of apoptosis in BPLER and HMLER after treatment with bortezomib, including regulators of mithocondrial membrane depolarization and factors acting downstream of mithocondria (FIG. 5A). Because some of these factors, such as Mcl-1, are cleaved upon caspase activation, we performed these experiments in the presence of zVAD-fmk. In both cell lines, bortezomib induced expression of Mcl-1 and the BH3-only proteins Noxa, Bik and Bim, while it inhibited post-mithocondrial factors XIAP and c-IAP1. However, bortezomib induced mithocondrial membrane depolarization in BPLER but not HMLER, indicating that pre-mithocondrial factors regulated the selective response of BPLER to proteasome inhibition (FIG. 5B). To identify factors mediating apoptosis at a functional level, we silenced the expression of 24 genes that were linked with bortezomib-induced cell death in previous studies. Of these, only Noxa silencing rescued BPLER cell death after bortezomib treatment to the same extent of the pan-caspase inhibitor zVAD-fmk (FIG. 5C). Indeed, Noxa protein is up regulated after treatment with bortezomib and mediates bortezomib-induced apoptosis in BPLER. However, Noxa was not sufficient for bortezomib-induced cell death, since HMLER overexpressed Noxa after treatment with bortezomib as well.

Figure 5D:
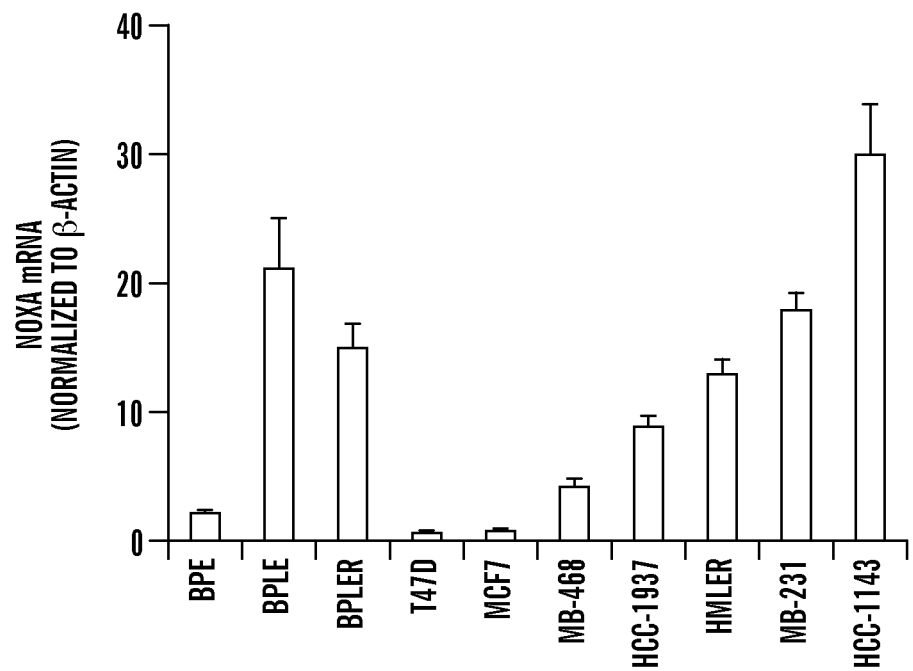
Figure 5E:
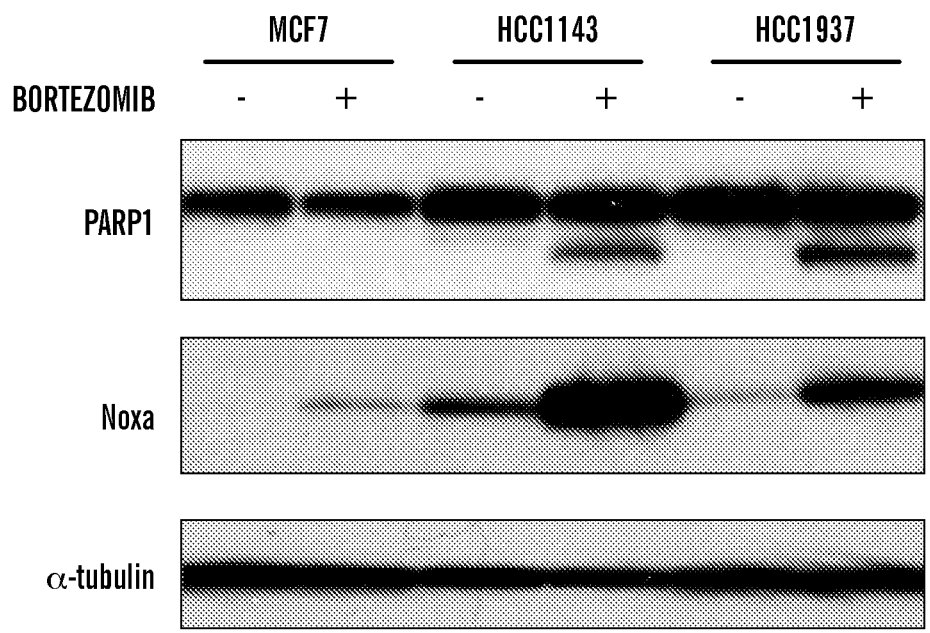
Figure 12B:
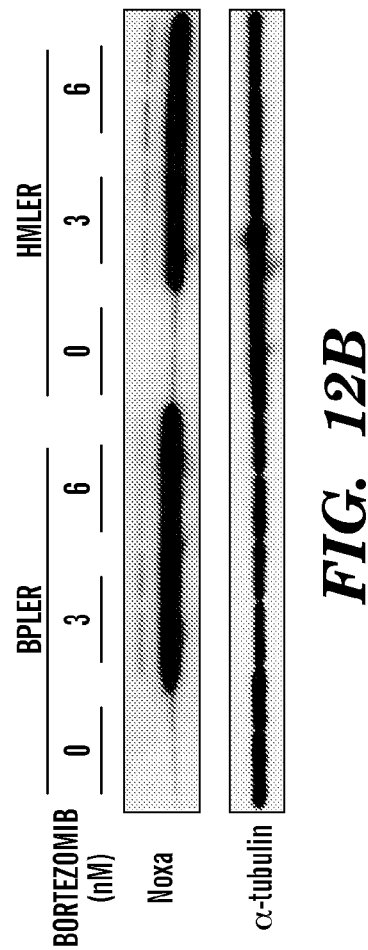
FIGS. 12A-12C demonstrate bortezomib induces Noxa protein expression in TNBC cells. (12A, 12B) Noxa mRNA (12A) and protein (12B) levels assessed by qRT-PCR and immunoblot, respectively, in BPLER and HMLER treated with bortezomib (12.5 nM) for 24 hr. Values in (12A) represent mean+/-SD of 3 replicates. (12C) Noxa protein levels in human breast cancer cell lines of different subtype after treatment with bortezomib (12.5 nM) or DMSO for 24 hours. All data are representative of at least three independent experiments.
Figure 12A:
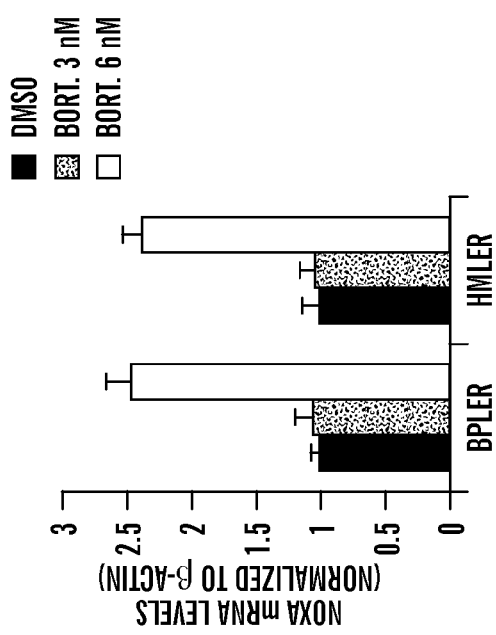
Figure 12C:
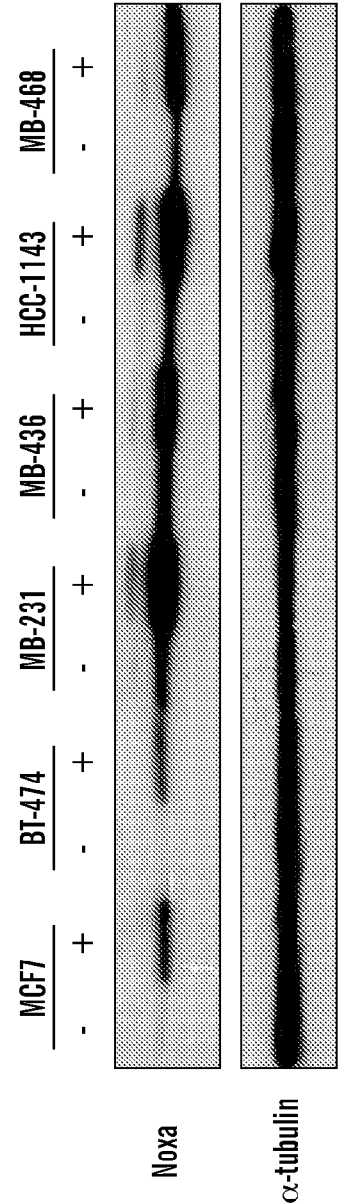
Figure 13:
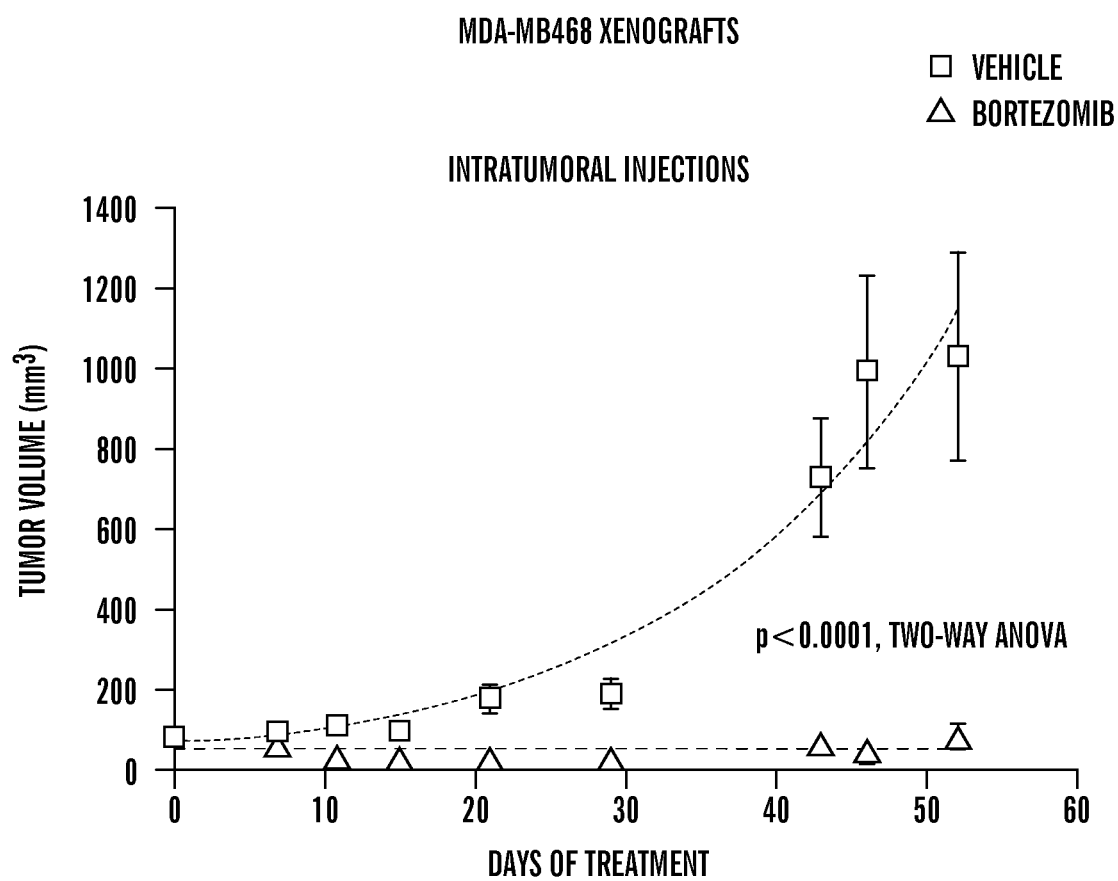
FIG. 13 demonstrates bortezomib suppresses TNBC growth in vivo. Mean tumor volume in MB-468 tumor-bearing mice upon intratumoral infusion of bortezomib (0.8 mg/kg) or DMSO q3d.

The accumulation of Noxa in both cells appeared to be regulated both transcriptionally and post-transcriptionally, since Noxa protein increased at a low bortezomib concentration that showed no change in mRNA (FIGS. 12A-12B). Notably, Noxa mRNA increased ~21-fold when BPE were transduced with SV40 early region (BPLE) and did not increase further after transduction with activated RAS (BPLER). Furthermore, TNBC lines expressed ~5-25-fold more baseline Noxa mRNA compared to untransformed BPE cells and poorly malignant luminal MCF7 and T47D cells, suggesting that Noxa transcriptional activation in mammary epithelial cells occurs upon transformation (FIG. 5D). Accordingly, bortezomib strongly induced Noxa protein in all the TNBC cell lines tested, but only weakly in BPE, MCF7 and T47D (FIG. 12C). Thus, TNBC cells are poised to Noxa protein accumulation upon proteasome inhibition. Of note, Noxa induction upon bortezomib treatment correlated with PARP1 cleavage in BPE, luminal MCF7 and epithelial TNBC cell lines (HCC-1143, MB-468 and HCC-1937, FIG. 5E).

Together, these data indicate that Noxa is a key mediator of bortezomib-induced cell death in TNBC epithelial cells.

Mcl-1 Dependency Underlies TNBC Sensitivity to Proteasome Inhibition.

Since differential expression of Noxa did not explain the selective sensitivity of BPLER and other epithelial TNBC cell lines to bortezomib, we sought to define the molecular mechanism underlying their selective dependence upon proteasome inhibition.

Figure 5F:
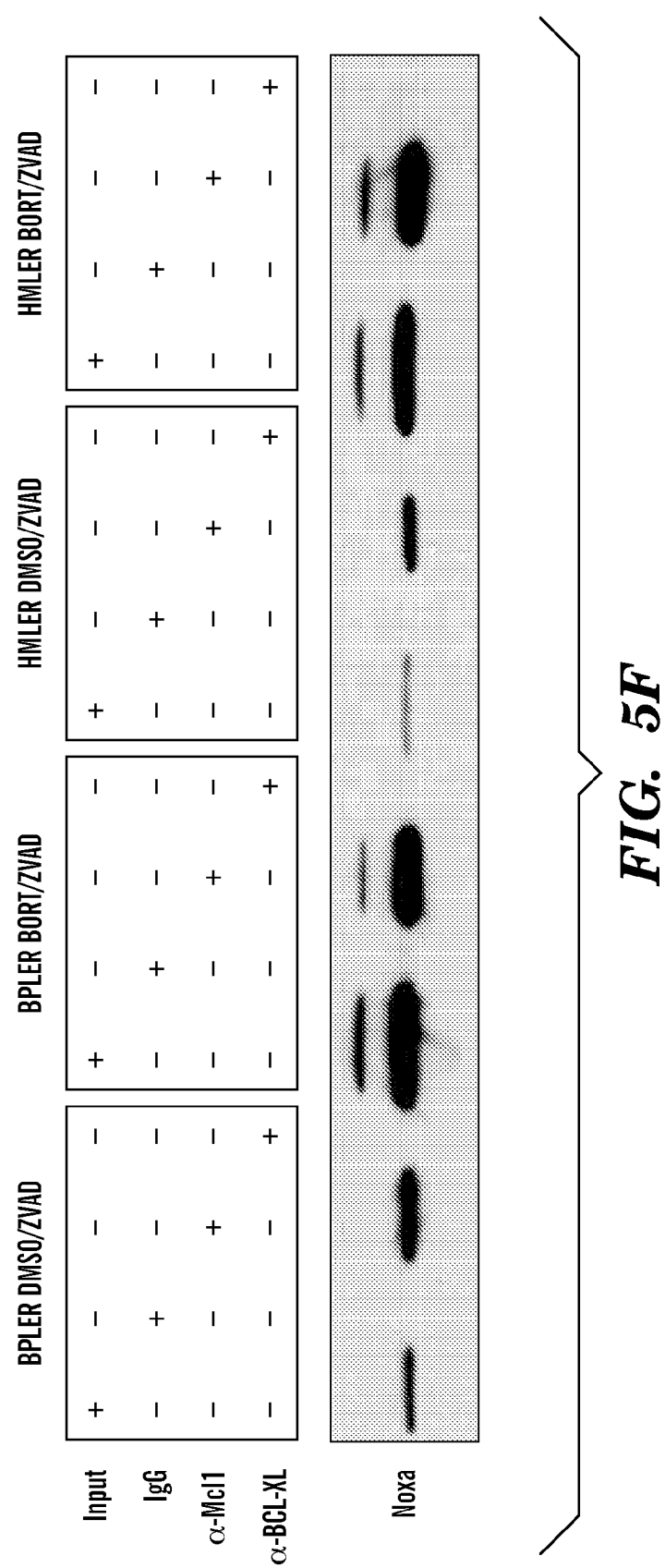

Noxa is an established, direct and specific antagonist of Mcl-1, which stood out as the only bcl-2 family member among BPLER dependency genes in our screen. Thus, we wished to determine whether BPLER selective response to proteasome inhibition depends on Noxa-mediated inactivation of Mcl-1. To test this, we first assessed Noxa/Mcl1 protein binding upon proteasome and caspase inhibition in BPLER and HMLER. In fact, Noxa bound to Mcl-1, but not Bcl-XL, in the 2 cell lines to a similar extent, indicating that Noxa was not just expressed at similar levels, but also equally capable of binding Mcl-1 (FIG. 5F).

Figure 5G:
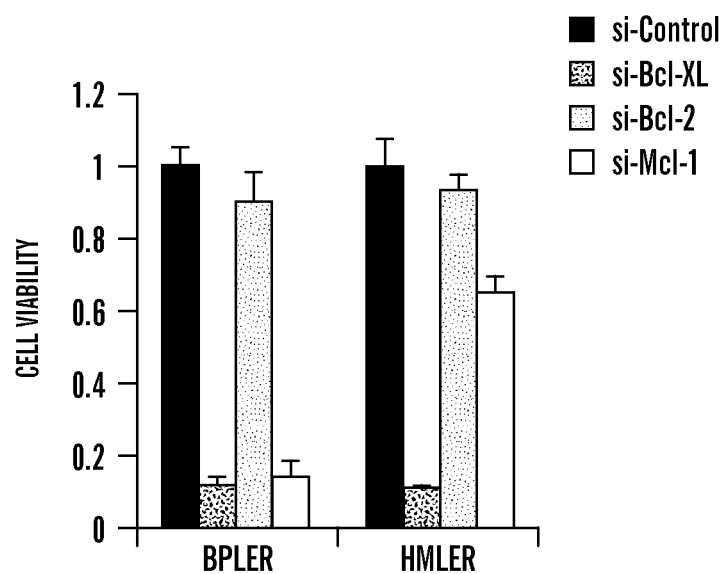

Then, we assessed BPLER and HMLER dependence upon distinct Bcl-2 family members. As expected, Mcl-1 silencing was selectively lethal to BPLER compared to HMLER, whereas BCL-XL silencing killed both BPLER and HMLER to a similar extent and BCL-2 silencing had no effect in either cell line. Hence, BPLER were selectively and specifically dependent on Mcl-1 for survival compared to HMLER, and Mcl-1 silencing was sufficient to recapitulate the lethal effect of proteasome inhibition (FIG. 5G).

Figure 5H:
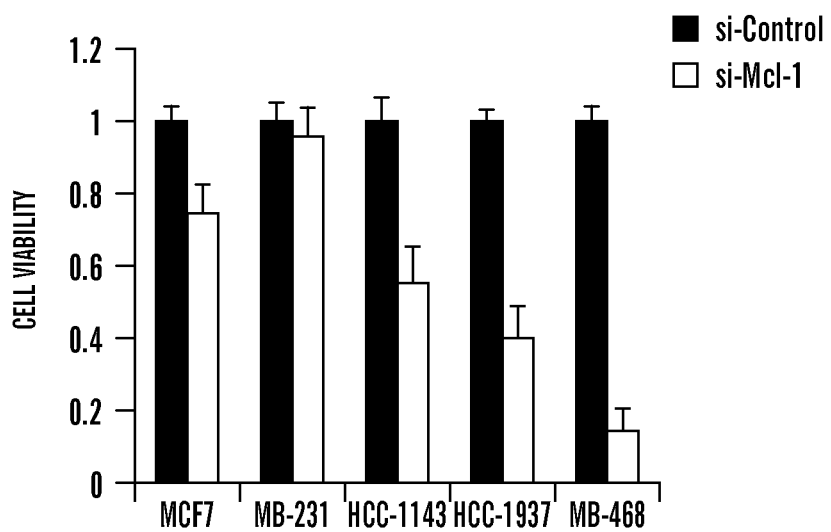

In order to validate these findings in other genetic and epigenetic contexts, we silenced Mcl-1 expression in breast cancer cell lines of different subtypes. As anticipated, Mcl-1 silencing was lethal to epithelial TNBC cell lines HCC-1937, HCC-1143 and MB-468, but not to luminal MCF7 and mesenchymal MB-231 cells. Notably, MB-468 that we demonstrated are exquisitely sensitive to bortezomib were also exquisitely sensitive to Mcl-1 silencing (FIG. 5H). Thus, other human epithelial TNBC cell lines, and not just BPLER, are selectively sensitive to Mcl-1 inhibition.

These data indicate that Mcl-1 dependency underlies the selective response of TNBC cells to proteasome inhibition. Because epithelial TNBC cells are intrinsically poised to Noxa accumulation and depend on Mcl-1 for survival, proteasome inhibition represents a viable therapeutic strategy to target Mcl-1 dependency in TNBC.

Proteasome Inhibition Suppresses TNBC Outgrowth In Vivo

Figure 6A:
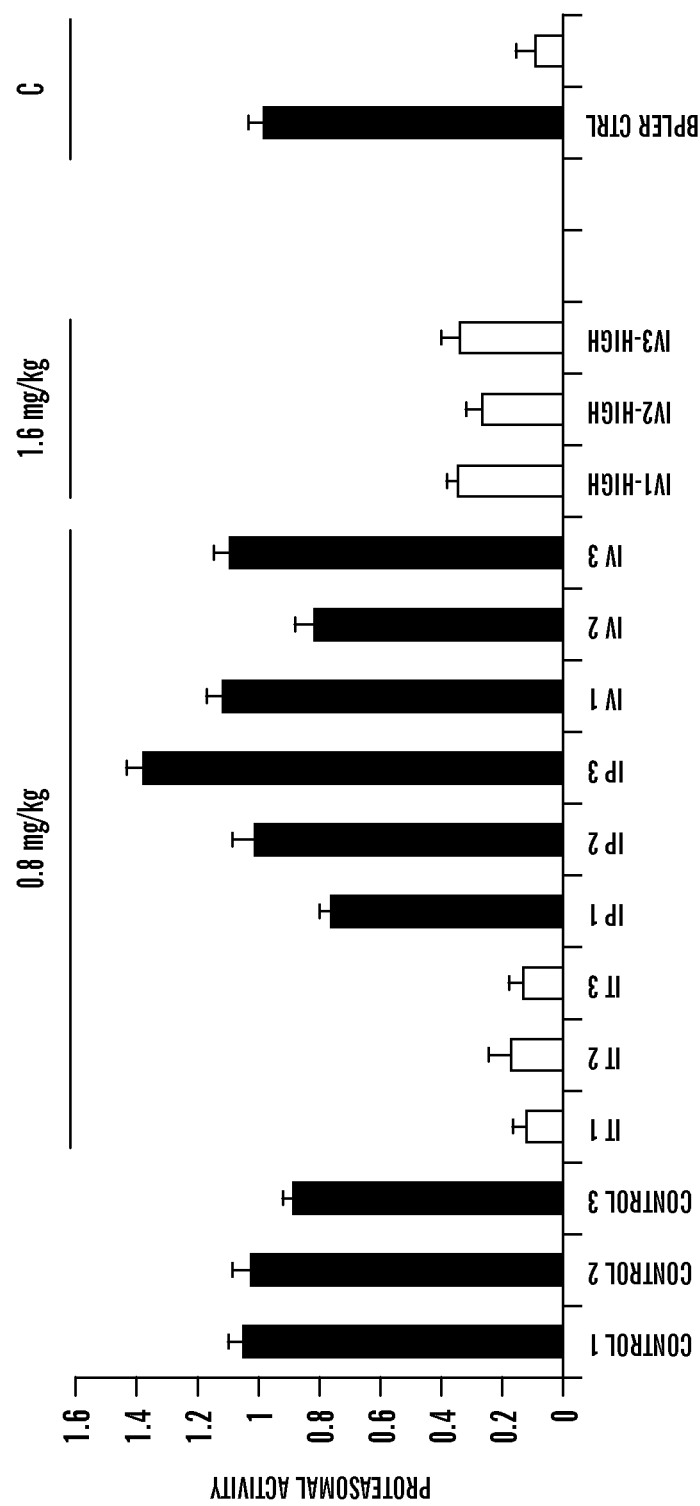
Figure 6B:
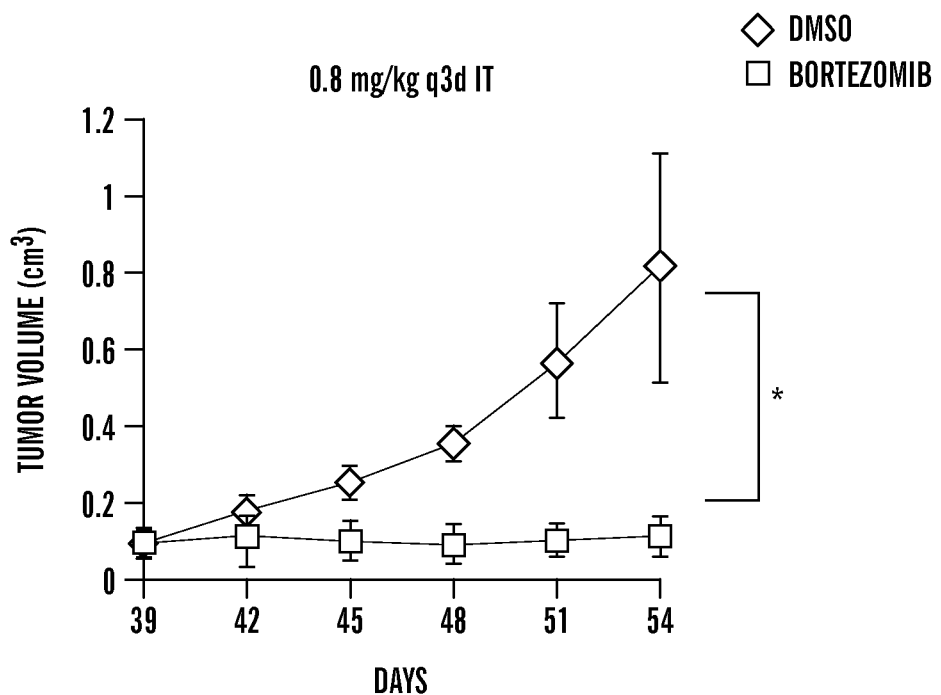
Figure 6C:
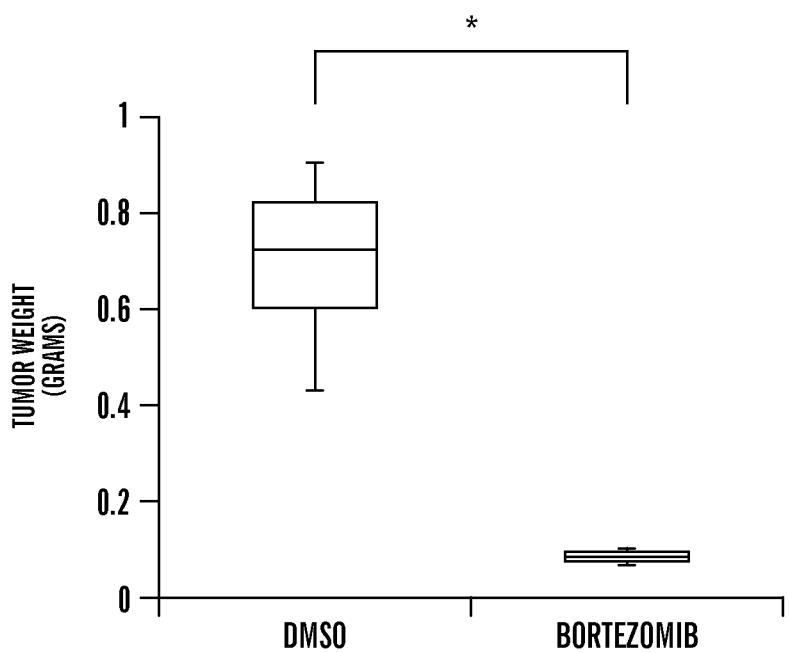
Figure 6D:
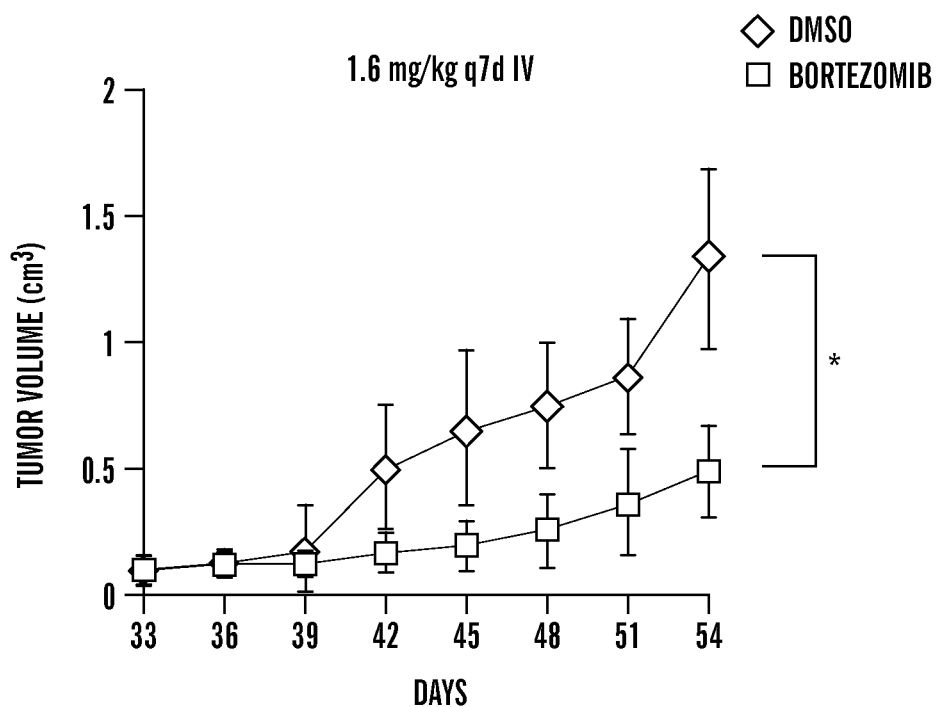
Figure 6E:
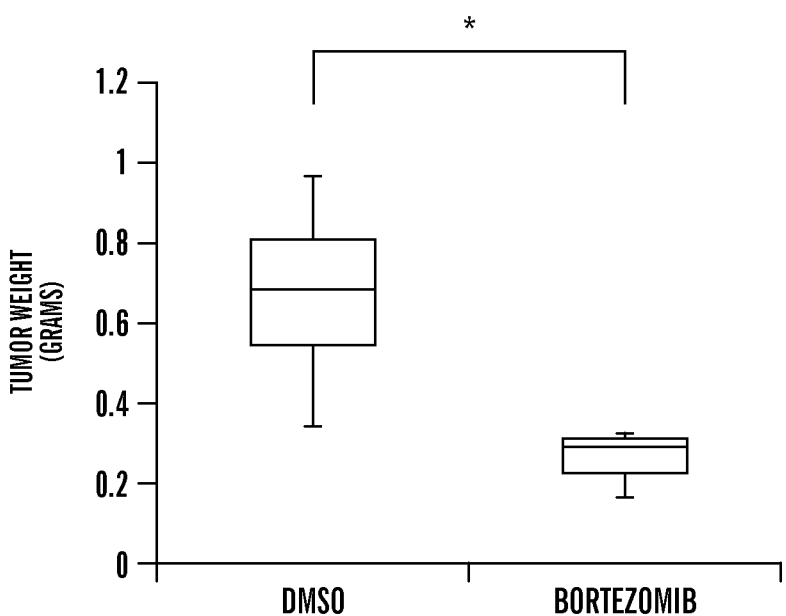
Figure 6F:
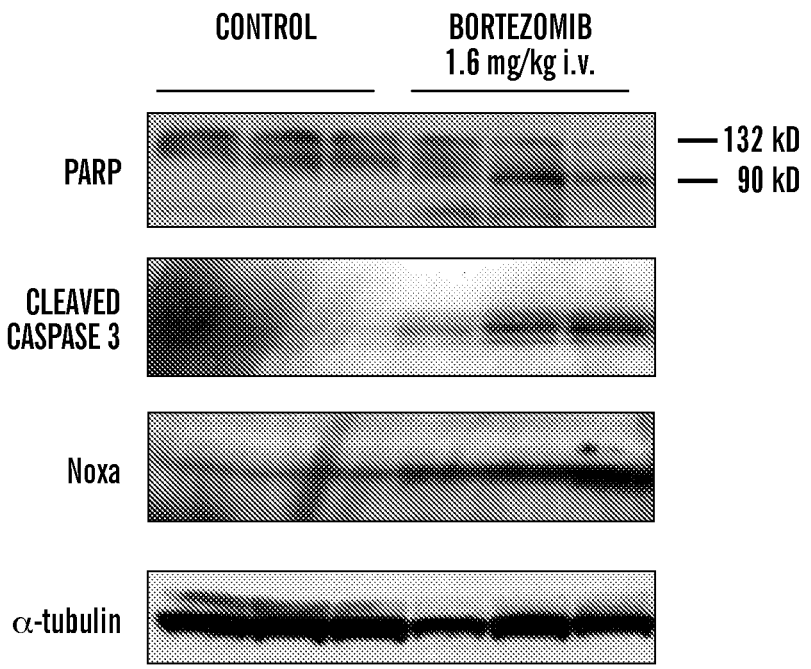
Figure 6G:
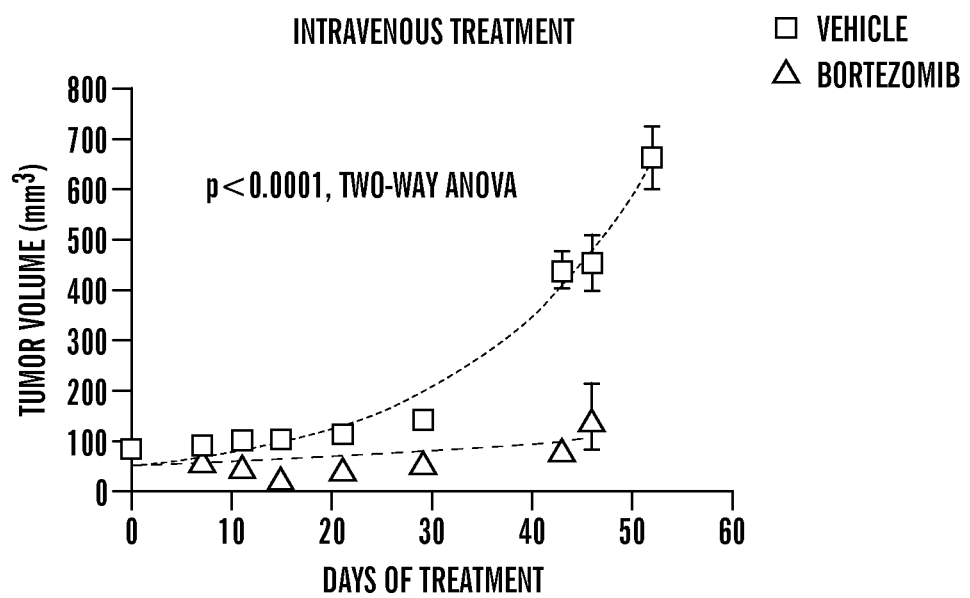

Our data thus far indicate that highly malignant epithelial TNBC cells are selectively susceptible to proteasome inhibition. Bortezomib is already in the clinic for treatment of multiple myeloma and other lymphomas. To start investigating potential clinical efficacy in TNBC, BPLER tumor-bearing mice were given 1 dose (0.8 mg/kg) of bortezomib intratumorally (i.t.), intraperitoneally (i.p) or intravenously (i.v.) and proteasome activity in the tumor was assessed after 18 hours (FIG. 6A). Nearly complete proteasome inhibition was achieved via i.t. injection, whereas i.p. and i.v. routes were less effective. However, increasing the dose of bortezomib to 1.6 mg/kg allowed efficient proteasome activity inhibition via systemic administration (i.v.). Thus, we used biologically active therapeutic regimens (0.8 mg/kg i.t. and 1.6 mg/kg i.v.) for subsequent experiments. To assess therapeutic efficacy, we administered bortezomib every 3 days (0.8 mg/kg i.t.) or weekly (1.6 mg/kg i.v.) after BPLER tumors, implanted in the flank of Nu/J mice, became palpable. BPLER tumor outgrowth was assessed by tumor volume during the treatment period and by tumor weight at the time of sacrifice. Compared to control mice, tumors in bortezomib-treated mice were on average from 85% (i.t.) to 59% (i.v.) smaller (p<0.01 and p<0.002, respectively), and weighed on average from 91% (i.t) to 63%% (i.v.) less compared to control mice (p<0.001 and p<0.006, respectively, FIG. 5b-e). Moreover, bortezomib induced Noxa induction and caspase 3 cleavage in vivo, as determined by immunohistochemistry and western blot analysis (FIG. 6F). Thus, bortezomib inhibited the activity of its intended target, induced Noxa accumulation, triggered apoptosis and suppressed tumor growth in BPLER tumor xenografts.

To further validate bortezomib efficacy in vivo, we used MB-468 that had shown dramatic response to proteasome inhibition in vitro. Treatment was started once mice developed palpable tumors. Using either intratumoral or intravenous therapeutic regimens, mice treated with bortezomib for 45 days had tumors that were smaller by at least 6-fold compared to control mice (p<0.0001 in both conditions, FIG. 6G and FIGS. 11A-11C).

Since most of our work was based on cancer cell lines, we sought to assess bortezomib efficacy using primary tumors from TP53 heterozygous Balb/c mice that develop TNBC with a 40-week latency. Breast tumors were resected from tumor-bearing mice and tumor fragments implanted into the mammary fat-pad of $TP53^{+/+}$ Balb/c recipient mice. After implantation, mice were randomized and treated with bortezomib weekly by i.v. infusion (FIG. 6H). Mice treated with bortezomib developed secondary tumors that were ~90% smaller and weighed ~80% less on average compared to control mice ($p<2.27 \times 10^{\wedge -6}$ and p<0.001, respectively, FIGS. 6I-6J). Histological examination confirmed that these tumors displayed an epithelial phenotype, resembled human TNBC histologically, and stained positive for CK14, thus retaining a TNBC phenotype.

Indeed, bortezomib-based therapy significantly suppressed tumor progression in a variety of epithelial TNBC models in both immunodeficient and immunocompetent mice.

A Chemogenetics Approach Reveals BPLER Selective Sensitivity to HDAC Inhibitor Drugs.

Figure 7A:
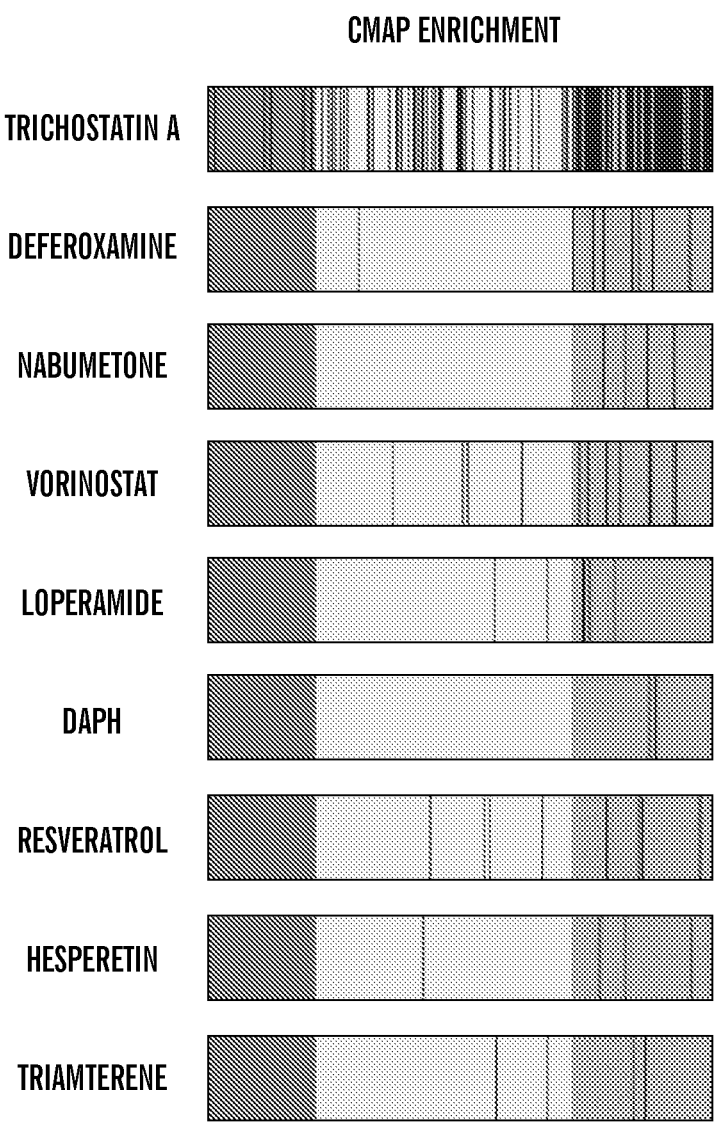
FIGS. 7A-7F demonstrate HDAC inhibitors target BPLER selectively. (7A) Connectivity map (CMAP) bar-view of changes in expression of malignancy associated response signature genes following in vitro treatment of cancer cell lines. Each black line represents an independent experiment that measured gene expression changes following treatment of an individual cancer cell line with the indicated drugs. Shaded areas are significantly enriched or depleted in malignancy associated response signature gene expression after drug exposure (p-values in Table 5). (7B) Viability of BPLER and HMLER cells treated with Trichostatin A, Vorinostat, Loperamide, Triamterene, Resveratrol or 4-5-dianilinophthalimide for 24 hr at the indicated dose. Data represent the mean+/−SD of 6 replicates. All data are representative of at least three independent experiments. (7C, 7D) mRNA expression, analyzed by qRT-PCR relative to ACTB, of malignancy associated response signature genes, predicted to be negatively regulated by TSA, in BPLER (7C) and HMLER (7D) cells 24 hr after treatment with 1 µM TSA. (7E-7F) Percentage of apoptotic cells (7E) and immunoblot analysis of PARP1 cleavage (7F) from BPLER 24 hours after treatment with DMSO, bortezomib (12.5 nM), vorinostat (10 uM) or bortezomib/vorinostat combination.
Figure 7B:
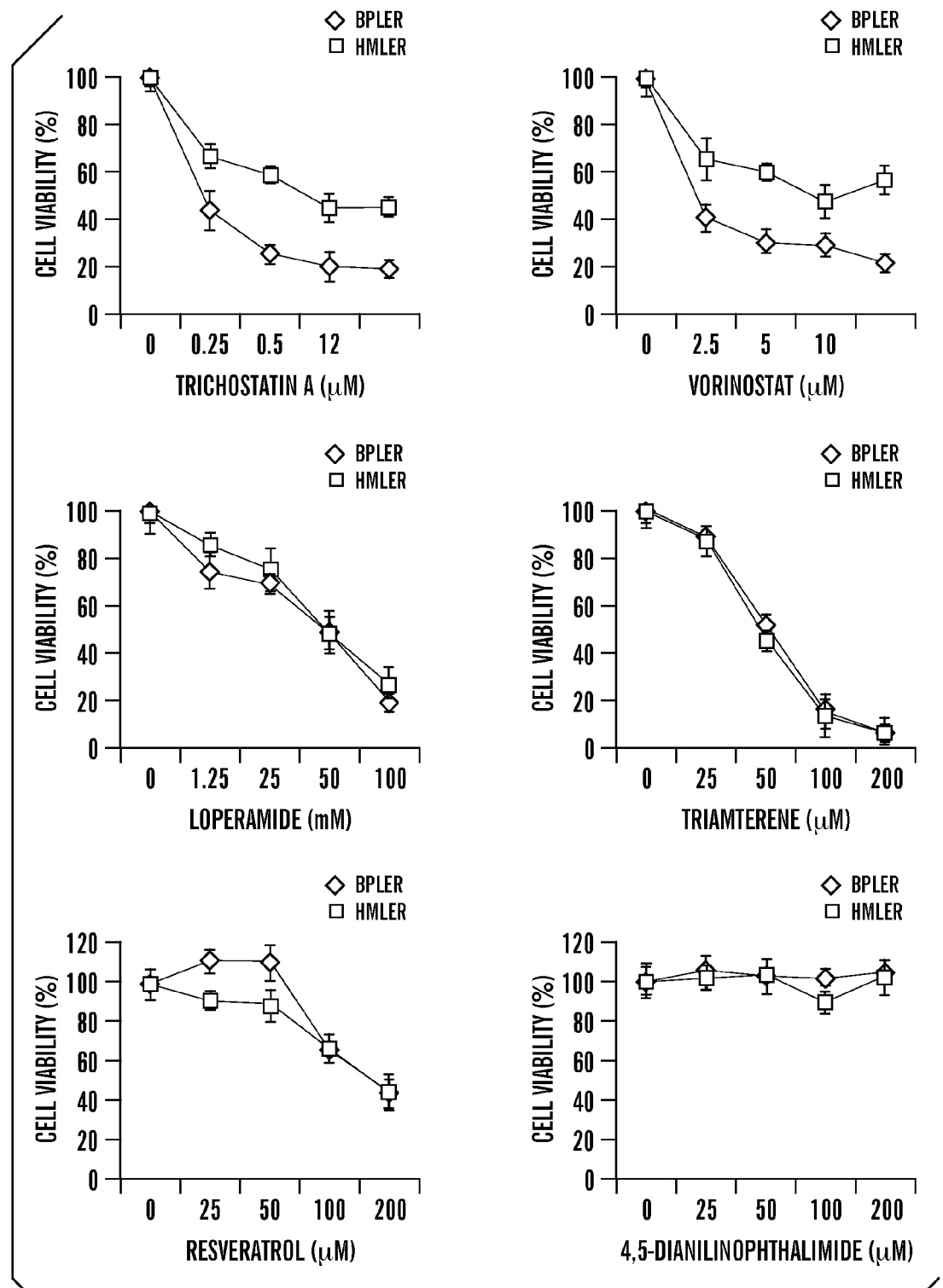
Figure 14:
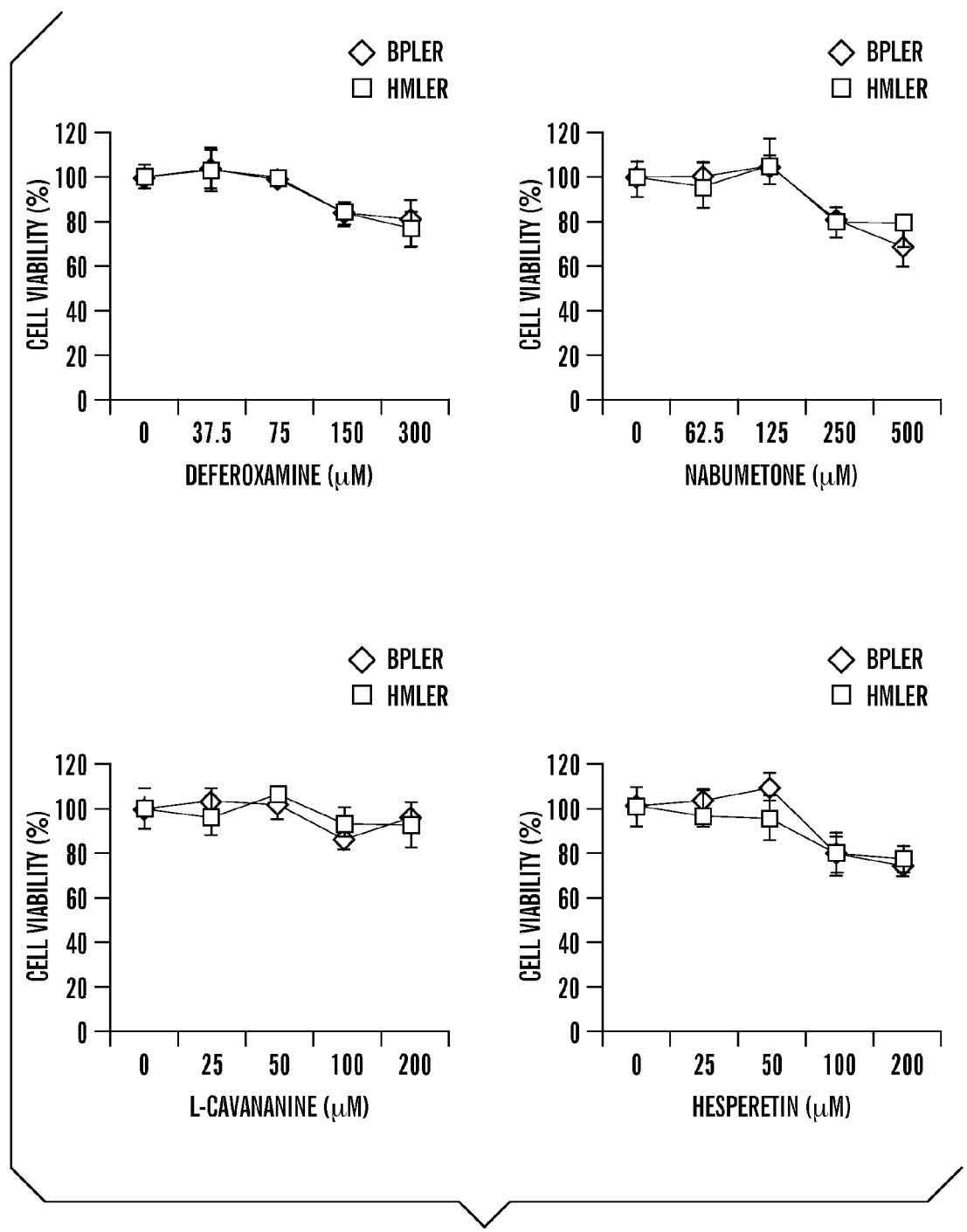
FIG. 14 depicts additional candidate drugs targeting BPLER. Relative viability, measured by CellTiterGlo, of BPLER and HMLER cells treated for 24 hr with Deferoxamine, Nabumetone, L-cavananine and Hesperetin. Viability is relative to cells grown in the absence of drug. These drugs were not active. Data represent the mean and standard deviation of six replicates. All data are representative of at least three independent experiments.

To identify additional small molecules that might be active against BPLER, we adopted a "chemogenetic" approach to compare the TGS with the connectivity map (CMAP), a collection of gene expression profiles of human cancer lines treated with bioactive molecules[22,23]. The CMAP contains genome-wide mRNA expression data from over 7,000 control vs drug-treated pairs of cancer cell lines that originated from diverse tissues exposed to a subset of 1,309 compounds. We reasoned that small molecules that suppress expression of TGS dependency genes might have selective activity against BPLER. 37 compounds significantly preferentially suppressed TGS gene expression in the CMAP (Table 5). We selected 10 drugs from this list for in vitro testing, based partly on their potential for clinical use (FIG. 7A). The histone deacetylase (HDAC) inhibitor Trichostatin A (TSA) most significantly suppressed TGS gene expression, which was shown in 182 independent control/TSA-treated cell experiments (P<0.0001). Treatment with another HDAC inhibitor (Vorinostat) also significantly suppressed expression of the TGS genes. The other drugs examined were Resveratrol, a natural product active in animal cancer models[24]; 4,5-dianilinophthalimide, an EGFR inhibitor; L-cavananine, an amino acid analog that competes with L-arginine; Nabumetone, a non-steroidal anti-inflammatory drug; Deferoxamine, an iron chelating agent with anti-cancer properties; Loperamide, an opioid-receptor agonist; Triamterene, a potassium-sparing diuretic; and Hesperetin, a bioflavenoid found in citrus fruits. Amongst these, 5 small molecules decreased BPLER viability at relatively low doses, of which 2 (the HDAC inhibitors TSA and Vorinostat) were selectively lethal for BPLER compared to HMLER (FIG. 7B and FIG. 14). Moreover, TSA and vorinostat had no effect on BPE viability at the indicated dose.

Figure 7C:
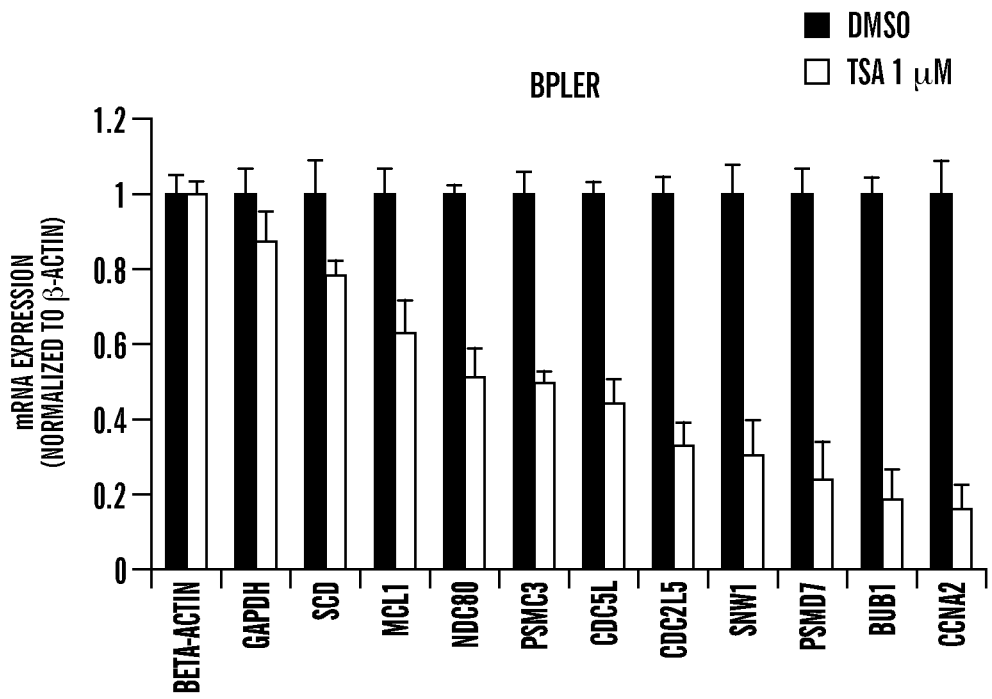
Figure 7D:
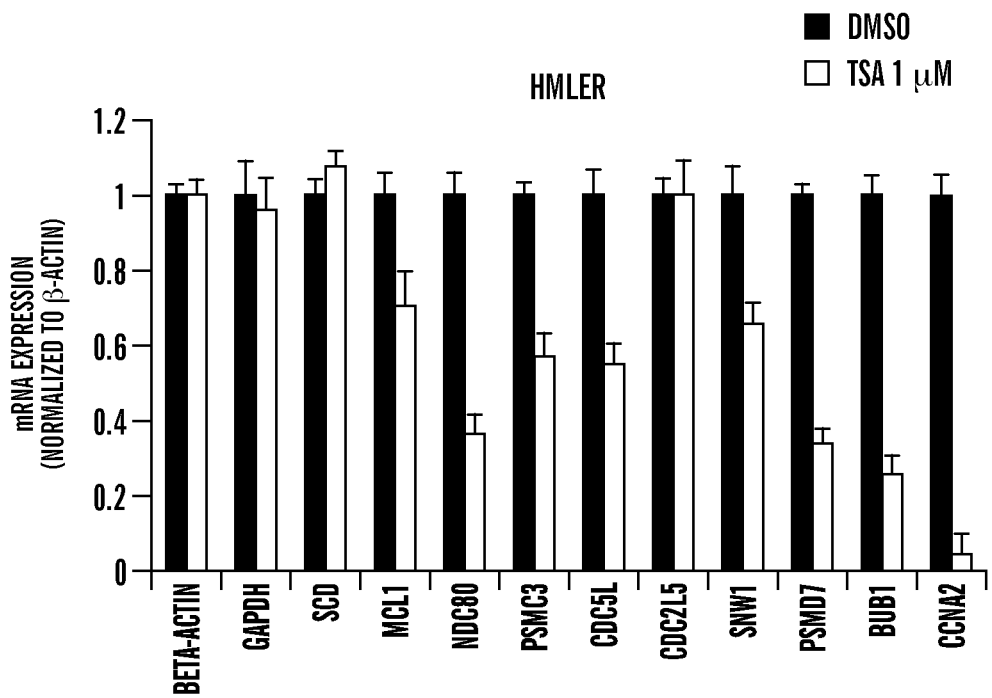

The CMAP data predicted that TSA would suppress expression of 52 TGS transcripts by ≥1.8-fold (Table 6). We measured the change in expression of the top 11 of these transcripts in BPLER and HMLER cells treated with TSA. Ten of these, including Mcl-1 and two proteasome subunit genes (PSMC3, PSMD7), were significantly decreased in BPLER cells treated with TSA (FIG. 7C). All but two of these also had significantly reduced expression in HMLER cells treated with TSA (FIG. 7D).

Figure 7E:
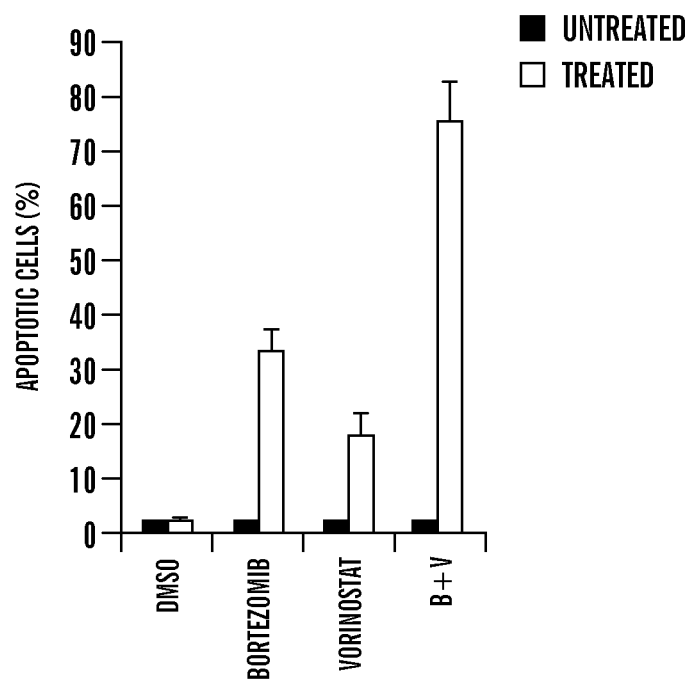
Figure 7F:
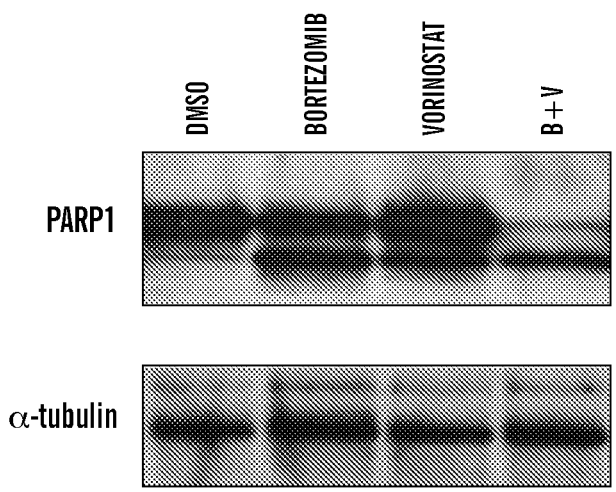

TSA synergized with bortezomib and increased apoptosis in BPLER (FIGS. 7E-7F), whereas the combination was not cytotoxic in untransformed BPE cells in vitro. Thus, HDAC inhibitor drugs selectively targeted highly malignant TNBC-initiating cells in the BPLER/HMLER system by regulating the expression of multiple genes on which such cells selectively depend for survival.

Discussion

Here we performed a genome-wide siRNA lethality screen of a genetically defined human breast cancer cell line (BPLER) to identify vulnerabilities and potential drug targets of highly malignant and poorly differentiated TNBC, the breast cancer subtype with the worst prognosis and response to current treatment. To our knowledge, this is the first RNAi-based high-throughput functional screen of a clinically relevant breast cancer cell type with a high frequency of tumor-initiating cells. Previous studies have focused on highly malignant mesenchymal breast tumor-initiating cells that give rise to mesenchymal breast tumors, a rare subtype of TNBC also known as "claudin-low". BPLER cells represent the first genetically defined model of tumor-initiating cells that give rise to human triple-negative epithelial adenocarcinomas, the most common type of TNBC encountered in the clinic.

Recent studies suggest that TNBC arises from transformed luminal epithelial progenitor cells[4-6,34,35]. Our data lend support to this hypothesis, because oncogenic transformation of human primary BPEC epithelial progenitor-like cells generates cancer lines enriched for BT-IC that give rise to tumors closely resembling human TNBC. Thus, BPEC-like epithelial progenitor cells may be the cell of origin of human TNBCs. This is unlikely to be an artifact of in vitro transformation, because introduction of the same genetic elements into myoepithelial-like cells (HMEC) does not induce TNBC[10]. The oncogenes used to transform BPE cells recapitulate common genetic alterations in TNBC, including loss of function of Tp53[36] and Rb[37] (which are inactivated by SV40) and activation of RAS signaling[38]. Indeed, transformation of human primary cells into TNBC tumor-initiating cells appears to depend on the cell of origin. However, it is possible that other combinations of oncogenes may also induce TNBC-like phenotypes from different cells of origin.

The cancer stem cell (CSC) hypothesis postulates that only a minor subpopulation of stem-cell-like cancer cells within a tumor retain tumor-initiating potential. While the CSC model may apply to certain low-grade tumors (including luminal breast tumors), it seems unlikely to describe TNBC, which are typically poorly differentiated lesions with a diffuse progenitor-like phenotype. The entire population of BPLER cells uniformly has the phenotype attributed to breast CSCs and only 50 cells are needed to initiate tumors in immunodeficient mice (we didn't try injecting smaller numbers). For poorly differentiated tumors like TNBC that arise from early progenitor cells, most of the tumor cells are likely to be tumor-initiating cells. Tumors with an early progenitor phenotype may not rely on malignant stem cells for self-renewal, an idea that has been supported by data using other poorly differentiated tumors[39]. Instead, poorly differentiated transformed bipotent epithelial progenitors can acquire self-renewing properties, and the bulk of cells in some poorly differentiated tumors can be capable of tumor initiation. It should be noted that HMLER cells, which do not efficiently generate tumors, also have the phenotype attributed to BT-IC. Thus there is a real need for additional BT-IC markers.

We identified 154 genes, which we termed a malignancy associated response signature (MARS) or TGS, which when silenced are selectively lethal for BPLER, but not for a closely related cell line (HMLER) derived from the same donor using the same transforming oncogenes. HMLER is myoepithelial-like and is unable to initiate tumors when injected at low numbers[10]. BPLER dependency genes include Mcl-1 and are highly enriched for proteasome subunits. The proteosome inhibitor bortezomib, currently approved for treatment of multiple myeloma and relapsed mantle cell lymphoma[26], causes caspase-dependent apoptosis in TNBC-initiating epithelial cells. These cells are especially sensitive to proteasome inhibition, because they selectively depend on Mcl-1 for survival and are intrinsically poised to Noxa protein accumulation, a potent inhibitor of Mcl-1. In fact, a number of human epithelial TNBC cell lines, and not just BPLER, appear to be selectively sensitive to Mcl-1 inhibition and to proteasome inhibitor drugs that induce Noxa. On the other hand, TNBC cell lines that express Noxa but do not depend on Mcl-1 for survival, such as mesenchymal MDA-MB-231, are also resistant to proteasome inhibition. Indeed, proteasome inhibitor drugs can be used to target Mcl-1 dependency for TNBC therapy. Identifying specific factors that regulate Noxa expression as well as Mcl-1 addiction, using the methods and assays described herein, can also provide novel therapeutic targets against TNBC.

Although clinical studies of bortezomib for unselected breast cancer subtypes have not been promising[27-29], our study indicates that further clinical evaluation of proteasome inhibitors for selected TNBC patients, which represent ~15% of breast cancer patients, is worthwhile. Recent studies indicate that achieving robust proteasome silencing in solid tumors can represent a major obstacle in the clinic. However, second-generation proteasome inhibitors with better pharmacokinetic profiles or targeting specific components in the ubiquitin-proteasome system, currently under clinical development, might hold promise for TNBC therapy. Our data also indicate that combining proteasome inhibitors with Mcl-1 inhibitors, also in preclinical development, can enhance clinical responses.

In this study we also used a novel approach to identify other potential drugs that are active against TNBC. We compared the CMAP that provides data on changes in global gene expression after exposure to bioactive molecules for many cancer cell lines with the list of MARS genes to identify drugs that selectively reduce expression of BPLER dependency genes. This approach, which illustrates the potential of combining siRNA screen results with CMAP or similar chemogenetics databases, identified HDAC inhibitors as selectively toxic for TNBC-initiating cells in the BPLER/HMLER system. HDAC inhibition suppressed multiple BPLER dependency genes, including Mcl-1 and proteasome subunits. In fact, TSA and bortezomib had a synergistic effect against BPLER. It is worth noting that HDAC inhibitors have been previously shown to target multiple myeloma cells and to synergize with bortezomib. In fact, 2 clinical trials for bortezomib/HDAC combination therapy (Velcade/Zolinza) in multiple myeloma are currently active. Indeed, TNBC-initiating cells appear to share selective functional dependencies with multiple myeloma cells, and indicates the activation of a related oncogenic program in distinct disease entities.

The MARS or TGS biomarkers (or the subset of the 23 biomarkers) can also be useful for identifying other potential TNBC drugs. Because the list is of a manageable size, the pathways for which there are multiple hits or the genes whose products lie at the nodes of the protein-protein interaction network can be evaluated as drug targets for TNBC, either for conventional drug development or for gene knockdown using small RNAs or antisense oligonucleotides. For example, the MARS also comprises glycolytic enzyme genes, and glycolysis inhibiting drugs are actively under development. We found that BPLER are highly reliant on glycolysis for ATP generation and are selectively sensitive to glycolysis inhibition.

A recent chemical screen identified the potassium ionophore salinomycin as a candidate drug active against highly malignant mesenchymal HMLER cells knocked down for E-cadherin[30]. Three hits in our screen, SLC4A5, SCL24A3 and SLC47A1, are potassium-sodium exchange transporters. It is worth investigating whether highly malignant breast cancer cells like BPLER that more closely resemble human breast tumors are also selectively sensitive to inhibition of specific ion transport.

TNBCs are sensitive to drugs like paclitaxel that inhibit mitosis and form the basis of current care. Our screen identified many genes involved in mitosis as required for BPLER survival. We verified that Mcl1 protein also declines in BPLER cells arrested in mitosis (by nocodazole, data not shown). Hence, combining proteosome inhibition with drugs that arrest cells in mitosis can be a synergistic approach.

The hits in our screen involved in the UPS and mitosis (the proteasome and the APC) overlap with genes identified in a recent genome-wide siRNA screen of synthetic lethal interactions with KRAS[32]. Because both BPLER and HMLER are transformed to express constitutively activated RAS, their differential dependence on these hits indicates that the effect of RAS activation is context-dependent and can be especially relevant in BT-IC or poorly differentiated tumors that arise from multipotent progenitor cells. In fact, we previously showed that RAS plays an important role in maintaining the self-renewal properties of BT-IC[33].

Expression of the 154 member MARS of BPLER dependency genes or the smaller subset of 23 highly selective hits provides a useful signature for, for example, predicting cancer prognosis, such as breast cancer prognosis, response to certain therapeutic drugs or probability of resistance or metastatic recurrence, as demonstrated herein. These results are also useful for stratifying patients for clinical studies, especially for drugs expected to impact the pathways enriched in the gene set. The prognostic value of this signature can also be used in luminal B subtype tumor prognosis, as we found by retrospective analysis that it discriminates between good and poor prognosis patients with luminal B subtype tumors.

Methods

Cell Culture.

Human BPE, BPLE, BPLER and HMLER cells were provided by R. Weinberg and T. Ince and grown in WIT medium (Stemgent). All experiments were performed with pairs of cells derived from the same patient (BPLER-2 and HMLER-2). Other human cell lines were obtained from ATCC and grown in DMEM, except for MCF7 (MEM) and HCC-1943 and HCC-1937 (RPMI), all supplemented with 10% FBS unless otherwise indicated. BPLER and HMLER cells were reverse-transfected with 50 nM siRNAs for screening and functional experiments using Dharmafect#1 (Dharmacon) or LIPOFECTAMINE 2000 (Invitrogen), respectively, in WIT medium. For drug treatment, cells were plated at 50,000-80,000 cells/well in 6-well plates or 1000 cells/well in 384-well plates in WIT and treated 24 hr later. Drug treatment of transfected cells was begun 24 hr after transfection. Cell viability was assessed by CELLTITER-GLO (Promega) in 384-well plates or by Trypan-Blue staining in 6-well plates. Chemoluminescence was measured using an ENVISION (PerkinElmer) high-throughput plate reader. Cell viability after treatment with BRPA was assessed by Trypan-Blue staining.

RNA Analysis.

qRT-PCR analysis was performed as described[41]. Briefly, total RNA was extracted with TRIZOL (Invitrogen) and cDNA prepared from 600-900 ng total RNA using THERMOSCRIPT RT kit (Invitrogen) as per the manufacturer's instructions. 2.5 ul of diluted cDNA (1:20) was used as template for qPCR using POWER SYBR-GREEN MASTER MIX (Applied Biosystems) and BIORAD C1000 THERMAL CYCLER (Biorad). Primer sequences are available upon request. Relative CT values were normalized to □-actin and converted to a linear scale using the $-\Delta CT$ method.

Protein Analysis.

Immunoblot was performed as described[41]. Primary antibodies were as follows: cleaved Caspase 3 (Cell Signaling, rabbit polyclonal, 1:1000), PARP1 (Santa Cruz, rabbit polyclonal, 1:500), MCL1 (Cell Signaling, Rabbit polyclonal, 1:1000), Bim (Santa Cruz, rabbit polyclonal, 1:500), Bik (Cell Signaling, rabbit polyclonal, 1:1000), Puma (Cell Signaling, rabbit polyclonal, 1:1000), Noxa (Calbiochem, mouse monoclonal, 1:500), Bid (Santa Cruz, rabbit polyclonal, 1:500), Bad (Santa Cruz, rabbit polyclonal, 1:500). Antibodies were diluted in 5% milk in TBS-T and incubated O.N. at 4° C. Secondary mouse and rabbit HRP-conjugated antibodies were from Amersham. Protein signal was detected using the ECL Plus kit (Amersham). For flow cytometry, cells were stained as previously described[33], using the following fluorescent-conjugated antibodies: CD44 (BD Biosciences), CD24 (BD Biosciences), CD326 (ESA, Biolegend), Annexin V (Invitrogen). For immunofluorescence microscopy, cells were fixed in 2% PFA for 10 min, permeabilized with 1% Triton X in PBS for 5 min, and incubated with primary antibodies in 0.5% Triton X, 1% FBS in PBS for 30 min at RT. Antibodies were: CK18 (Santa Cruz, mouse monoclonal, 1:100) and CK14 (Millipore, mouse monoclonal, 1:100). After washing the cells were stained sequentially with AlexaFluor647-conjugated secondary antibody (Invitrogen, 1:200) and DAPI (Sigma, 1:5000). For immunohistochemistry, BPLER tumor sections were prepared from paraffin-embedded tissues, deparaffinized and treated with 10% citrate buffer for 15 min. Staining was performed using a BIOGENEX IHC DAB kit (Biogenex) following the manufacturer's protocol. Primary antibodies were: CK14 (Millipore, mouse monoclonal, 1:100), CK5 (Millipore, mouse monoclonal, 1:100), HH3 (Cell Signaling, rabbit polyclonal, 1:100), ER (Abcam, mouse monoclonal, 1:100), Vimentin (Invitrogen, mouse monoclonal 1:100), Ki67 (Millipore, mouse monoclonal, 1:100).

In Vivo Experiments.

All animal procedures were performed with IACUC approval. Exponentially growing cells were trypsinized with TRYPLE EXPRESS (Invitrogen), resuspended in a 1:1 WIT-Matrigel solution at the indicated numbers, and injected subcutaneously in the flank of 4-week old female Nu/J mice (Stock #002019, Jackson Laboratories). For bortezomib treatment, beginning 21 days after BPLER cells were injected (when tumors became palpable), mice bearing tumors of comparable size were randomized into two groups and treated i.p. q3d with bortezomib 0.5 mg/kg or DMSO, respectively. Mice were sacrificed 16 days after beginning treatment and tumor weight was assessed.

RNAi Screen.

Automated screening procedures were performed at the Harvard ICCB-L Screening Facility using Human siGenome siRNA libraries (Dharmacon). Procedures were optimized and validated for high-throughput screening under ICCB-L guidance. Screening conditions were identical for BPLER and HMLER cells. In the primary screen, library plates that contained siRNAs no longer supported by transcript evidence were not screened. For each cell line, each siRNA or pool of siRNAs was transfected in triplicate wells. Each microplate included 8 negative and 8 positive internal controls, which were used to monitor experimental conditions across the screen. Only microplates with a Z' factor >0.5 were analyzed (covering 98.7% of the siRNA library). WELLMATE rapid plate dispensers and Teflon-coated manifolds (Matrix) were used to dispense the cells. siRNAs libraries were transferred into 384-well assay plates using liquid handling robots (VELOCITY 11 BRAVO). siRNAs were reverse-transfected at a final concentration of 50 nM in 384-well white/clear microplates (Corning Cat. #3707) using Dharmafect #1 (Dharmacon) in WIT medium. Fresh medium was added after 24 hours and cell viability was assessed by CELLTITERGLO (Promega) 3 days after transfection using an ENVISION high-throughput plate reader (Perkin-Elmer).

Screening Hit Selection.

Viability scores were judged based on a combination of parameters, including relative standard deviation among replicates (RSD), median absolute deviation (MAD)-based Z score (Z score), fold-change from the plate median (FC), and BPLER/HMLER FC ratio (R)[42]. For each set of triplicate plates, siRNAs with RSD >0.25 were excluded. Any siRNAs causing severe cytotoxicity to HMLER(HMLER Z score ≤−3 or HMLER FC ≤0.5) were also excluded from further analysis. siRNAs were considered hits if they satisfied the following criteria: BPLER Z score ≤−1.5, BPLER FC ≤0.75, R≤0.75. Positive hits were classified into highly, moderately or modestly selective based on R values. The positive hits were subjected to a secondary screen in which cells were transfected individually with the 4 siRNAs in the positive pools. Hits were considered validated if wells treated with at least one siRNA in the pool met the same criteria used in the primary screen.

Microarray Analysis.

Human breast tumor array data was obtained from two previous studies on Agilent and Affymetrix arrays (UNC dataset[12], 337 cases and Richardson dataset[13], 47 cases). The gene expression profile of BPLER tumor explants was acquired using Affymetrix arrays. For cross platform comparison arrays were rank normalized using only genes common to all arrays. To account for the fact that all of the stromal genes in the BPLER xenografts are of mouse origin, a principal component analysis was used to identify the major component that separated the tumor and BPLER arrays and these genes were excluded from the subsequent analysis. The samples were co-clustered based on the remaining genes that were differentially expressed across the tumor dataset by Ward's minimum variance method according to Spearman correlation coefficients (GEO references GSE18229, GSE3744 and GSE6885).

Survival Analysis of Primary Tumor Datasets.

The expression of the TGS and highly specific gene signatures were assessed in each tumor sample in the NKI dataset[14] using the single-sample GSEA enrichment score, as previously described[43]. Briefly, each sample was rank-normalized and an enrichment score was obtained by a weighted sum of the difference between the empirical distribution functions of the genes in the signature and that of the remaining genes. The enrichment scores were classified as low and high expression, according to the p-value associated with up-regulation of expression of TGS genes. Tumors whose score ranked with $p<0.1$ were assigned to the high expression group and the remaining tumors were defined as low. Survival and metastasis-free survival curves were derived using the Kaplan-Meier method.

Tables for Examples 1 and 2

TABLE 1

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 79864 | NM_024806 | C11orf63 | −1.69 | −2.37 | 0.709 | 0.63 | 1.12 |
| 54934 | NM_017822 | C12orf41 | −1.53 | −1.15 | 0.652 | 0.84 | 0.78 |
| 80209 | NM_025138 | C13orf23 | −1.78 | −1.61 | 0.680 | 0.72 | 0.95 |
| 221150 | NM_145061 | C13orf3 | −1.66 | −0.47 | 0.694 | 0.92 | 0.76 |
| 283598 | NM_182560 | C14orf177 | −2.78 | −2.57 | 0.401 | 0.48 | 0.83 |
| 283635 | NM_173607 | C14orf24 | −1.66 | −1.94 | 0.638 | 0.60 | 1.06 |
| 64207 | NM_024496 | C14orf4 | −1.63 | −0.21 | 0.731 | 0.97 | 0.75 |
| 348110 | NM_182616 | C15orf38 | −2.27 | −2.24 | 0.626 | 0.67 | 0.93 |
| 90381 | NM_152259 | C15orf42 | −1.66 | −1.47 | 0.666 | 0.78 | 0.85 |
| 283897 | NM_175900 | C16orf54 | −1.80 | −1.98 | 0.611 | 0.60 | 1.02 |
| 146850 | XM_375404 | C17orf38 | −2.01 | −1.40 | 0.643 | 0.79 | 0.82 |
| 79018 | NM_024052 | C17orf39 | −2.16 | −3.69 | 0.646 | 0.42 | 1.53 |
| 79002 | NM_024038 | C19orf43 | −2.54 | −2.67 | 0.587 | 0.59 | 0.99 |
| 79098 | NM_023938 | C1orf116 | −1.83 | −1.56 | 0.695 | 0.75 | 0.92 |
| 26099 | NM_015609 | C1orf144 | −2.02 | −1.72 | 0.680 | 0.71 | 0.95 |
| 149466 | NM_182517 | C1orf210 | −1.51 | −1.60 | 0.731 | 0.76 | 0.96 |
| 54823 | NM_017673 | C1orf26 | −1.93 | −1.87 | 0.677 | 0.74 | 0.91 |
| 79078 | NM_024097 | C1orf50 | −1.59 | −1.40 | 0.741 | 0.78 | 0.96 |
| 79871 | NM_024813 | C1orf82 | −3.98 | −3.04 | 0.313 | 0.53 | 0.59 |
| 140701 | NM_080622 | C20orf135 | −1.83 | −2.55 | 0.676 | 0.63 | 1.08 |
| 253143 | NM_173566 | C22orf30 | −1.73 | −0.57 | 0.728 | 0.90 | 0.81 |
| 56947 | NM_020194 | C2orf33 | −1.84 | −1.21 | 0.703 | 0.81 | 0.86 |
| 80304 | NM_025203 | C2orf44 | −1.89 | −1.33 | 0.665 | 0.75 | 0.88 |
| 57415 | NM_020685 | C3orf14 | −1.71 | −1.56 | 0.721 | 0.76 | 0.95 |
| 25871 | NM_015412 | C3orf17 | −1.78 | −1.18 | 0.721 | 0.82 | 0.88 |
| 131831 | NM_152394 | C3orf44 | −1.58 | −1.76 | 0.715 | 0.72 | 0.99 |
| 206412 | XM_116497 | C6orf163 | −1.72 | −1.54 | 0.728 | 0.73 | 1.00 |
| 253714 | NM_198468 | C6orf167 | −2.12 | −1.24 | 0.665 | 0.79 | 0.84 |
| 221261 | XM_168053 | C6orf184 | −2.22 | −1.47 | 0.650 | 0.75 | 0.86 |
| 221718 | NM_152738 | C6orf218 | −1.84 | −1.20 | 0.709 | 0.79 | 0.90 |
| 84302 | NM_032342 | C9orf125 | −2.46 | −2.37 | 0.528 | 0.61 | 0.87 |
| 138240 | XM_059954 | C9orf57 | −1.71 | −1.30 | 0.668 | 0.77 | 0.86 |
| 55684 | NM_024718 | C9orf86 | −1.61 | −1.92 | 0.654 | 0.71 | 0.92 |
| 203245 | NM_197956 | C9orf90 | −1.59 | −1.10 | 0.749 | 0.82 | 0.91 |
| 56344 | NM_019855 | CABP5 | −1.81 | −0.50 | 0.708 | 0.92 | 0.77 |
| 773 | NM_000068 | CACNA1A | −2.11 | −1.83 | 0.607 | 0.68 | 0.90 |
| 775 | NM_000719 | CACNA1C | −1.67 | −1.39 | 0.688 | 0.76 | 0.91 |
| 83698 | NM_031468 | CALN1 | −1.61 | −0.95 | 0.695 | 0.84 | 0.83 |
| 55450 | NM_018584 | CAMK2N1 | −3.80 | −1.54 | 0.626 | 0.72 | 0.87 |
| 824 | NM_001748 | CAPN2 | −2.18 | −2.55 | 0.651 | 0.61 | 1.08 |
| 84290 | NM_032330 | CAPNS2 | −1.68 | −1.12 | 0.681 | 0.81 | 0.84 |
| 84433 | NM_032415 | CARD11 | −1.64 | −0.70 | 0.732 | 0.88 | 0.83 |
| 64170 | NM_022352 | CARD9 | −1.53 | −0.81 | 0.744 | 0.87 | 0.86 |
| 57524 | NM_020764 | CASKIN1 | −1.84 | −0.86 | 0.701 | 0.87 | 0.81 |
| 9994 | NM_012115 | CASP8AP2 | −2.05 | −1.66 | 0.631 | 0.70 | 0.90 |
| 863 | NM_005187 | CBFA2T3 | −2.46 | −1.32 | 0.673 | 0.74 | 0.90 |
| 79872 | NM_024814 | CBLL1 | −2.41 | −3.24 | 0.585 | 0.50 | 1.17 |
| 56267 | NM_019610 | CCBL2 | −1.88 | −1.17 | 0.695 | 0.82 | 0.85 |
| 80125 | NM_182791 | CCDC33 | −1.80 | −0.89 | 0.675 | 0.84 | 0.80 |
| 120935 | NM_182496 | CCDC38 | −2.30 | −2.54 | 0.588 | 0.65 | 0.91 |
| 152185 | NM_144718 | CCDC52 | −1.96 | −1.89 | 0.699 | 0.70 | 0.99 |
| 29080 | NM_014167 | CCDC59 | −1.68 | −1.50 | 0.702 | 0.77 | 0.92 |
| 83987 | NM_032040 | CCDC8 | −1.89 | −1.82 | 0.643 | 0.70 | 0.91 |
| 283234 | NM_032251 | CCDC88B | −1.73 | −0.89 | 0.638 | 0.83 | 0.77 |
| 54908 | NM_017785 | CCDC99 | −2.46 | −3.48 | 0.420 | 0.48 | 0.88 |
| 6361 | NM_002987 | CCL17 | −2.11 | −2.30 | 0.610 | 0.64 | 0.96 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 6367 | NM_002990 | CCL22 | −2.48 | −1.42 | 0.685 | 0.79 | 0.87 |
| 6370 | NM_005624 | CCL25 | −1.69 | −1.03 | 0.688 | 0.83 | 0.83 |
| 10344 | NM_006072 | CCL26 | −2.37 | −1.16 | 0.697 | 0.82 | 0.85 |
| 891 | NM_031966 | CCNB1 | −1.92 | −1.21 | 0.652 | 0.78 | 0.83 |
| 8812 | NM_003858 | CCNK | −3.07 | −2.54 | 0.443 | 0.54 | 0.81 |
| 1235 | NM_004367 | CCR6 | −1.77 | −1.74 | 0.674 | 0.73 | 0.92 |
| 1237 | NM_005201 | CCR8 | −1.61 | −0.87 | 0.704 | 0.86 | 0.82 |
| 23552 | NM_012119 | CCRK | −1.75 | −1.15 | 0.744 | 0.84 | 0.88 |
| 10575 | NM_006430 | CCT4 | −2.55 | −1.70 | 0.538 | 0.69 | 0.78 |
| 930 | NM_001770 | CD19 | −2.12 | −0.99 | 0.726 | 0.85 | 0.85 |
| 910 | NM_001764 | CD1B | −1.90 | −1.02 | 0.657 | 0.82 | 0.80 |
| 4345 | NM_005944 | CD200 | −1.53 | −1.77 | 0.706 | 0.71 | 1.00 |
| 934 | NM_013230 | CD24 | −2.59 | −2.38 | 0.527 | 0.57 | 0.92 |
| 51744 | NM_016382 | CD244 | −1.51 | −1.13 | 0.725 | 0.80 | 0.91 |
| 10849 | NM_012099 | CD3EAP | −1.76 | −0.24 | 0.746 | 0.96 | 0.78 |
| 962 | NM_001778 | CD48 | −1.59 | −1.42 | 0.657 | 0.80 | 0.83 |
| 55143 | NM_018101 | CDCA8 | −2.19 | −3.49 | 0.480 | 0.48 | 1.00 |
| 8558 | NM_003674 | CDK10 | −1.81 | −1.03 | 0.734 | 0.86 | 0.86 |
| 80279 | NM_025197 | CDK5RAP3 | −3.10 | −2.74 | 0.548 | 0.63 | 0.87 |
| 125931 | NM_198444 | CEACAM20 | −3.05 | −2.95 | 0.451 | 0.59 | 0.77 |
| 1951 | NM_001407 | CELSR3 | −1.53 | −0.80 | 0.718 | 0.87 | 0.83 |
| 1062 | NM_001813 | CENPE | −2.75 | −2.61 | 0.590 | 0.58 | 1.03 |
| 2491 | NM_006733 | CENPI | −1.54 | −1.59 | 0.692 | 0.76 | 0.92 |
| 79172 | NM_024322 | CENPO | −2.42 | −2.22 | 0.597 | 0.65 | 0.92 |
| 22897 | XM_374936 | CEP164 | −3.04 | −2.08 | 0.565 | 0.66 | 0.86 |
| 1073 | NM_021914 | CFL2 | −1.80 | −1.17 | 0.614 | 0.81 | 0.75 |
| 114335 | NM_033377 | CGB1 | −1.57 | −1.01 | 0.716 | 0.82 | 0.87 |
| 79094 | NM_024111 | CHAC1 | −2.41 | −2.44 | 0.602 | 0.61 | 0.98 |
| 1108 | NM_001273 | CHD4 | −2.00 | −2.22 | 0.702 | 0.64 | 1.10 |
| 1111 | NM_001274 | CHEK1 | −4.19 | −3.53 | 0.387 | 0.52 | 0.74 |
| 27243 | NM_014453 | CHMP2A | −1.95 | −3.58 | 0.655 | 0.45 | 1.47 |
| 91782 | NM_152272 | CHMP7 | −1.70 | −2.32 | 0.676 | 0.67 | 1.01 |
| 91851 | NM_145234 | CHRDL1 | −1.64 | −1.11 | 0.689 | 0.84 | 0.82 |
| 1131 | NM_000740 | CHRM3 | −1.58 | −2.09 | 0.709 | 0.68 | 1.05 |
| 8973 | NM_004198 | CHRNA6 | −2.24 | −0.51 | 0.722 | 0.92 | 0.78 |
| 1178 | NM_001828 | CLC | −1.52 | −0.67 | 0.670 | 0.89 | 0.75 |
| 1186 | NM_001287 | CLCN7 | −2.32 | −1.62 | 0.716 | 0.73 | 0.98 |
| 137075 | NM_194284 | CLDN23 | −1.81 | −1.03 | 0.655 | 0.83 | 0.79 |
| 7123 | NM_003278 | CLEC3B | −2.02 | −1.63 | 0.712 | 0.76 | 0.93 |
| 25932 | NM_013943 | CLIC4 | −2.44 | −1.65 | 0.699 | 0.73 | 0.96 |
| 55907 | NM_018686 | CMAS | −1.63 | −1.53 | 0.637 | 0.78 | 0.82 |
| 1259 | NM_000087 | CNGA1 | −2.20 | −1.70 | 0.604 | 0.70 | 0.87 |
| 10256 | NM_006314 | CNKSR1 | −2.74 | −3.15 | 0.599 | 0.57 | 1.05 |
| 23019 | NM_016284 | CNOT1 | −2.74 | −2.06 | 0.571 | 0.67 | 0.85 |
| 1271 | NM_001842 | CNTFR | −2.00 | −0.63 | 0.722 | 0.90 | 0.80 |
| 53942 | NM_014361 | CNTN5 | −1.72 | −1.95 | 0.689 | 0.65 | 1.06 |
| 1297 | NM_001851 | COL9A1 | −3.17 | −2.16 | 0.605 | 0.66 | 0.91 |
| 150684 | NM_152516 | COMMD1 | −2.28 | −0.95 | 0.648 | 0.85 | 0.76 |
| 9276 | NM_004766 | COPB2 | −4.48 | −3.75 | 0.343 | 0.49 | 0.70 |
| 22820 | NM_016128 | COPG | −3.44 | −2.50 | 0.506 | 0.59 | 0.86 |
| 8533 | NM_003653 | COPS3 | −1.63 | −0.62 | 0.705 | 0.89 | 0.79 |
| 10987 | NM_006837 | COPS5 | −1.51 | −1.19 | 0.727 | 0.79 | 0.92 |
| 10980 | NM_006833 | COPS6 | −2.32 | −1.14 | 0.666 | 0.81 | 0.82 |
| 22818 | NM_016057 | COPZ1 | −3.63 | −2.53 | 0.479 | 0.58 | 0.82 |
| 1325 | NM_001302 | CORT | −1.63 | −2.84 | 0.667 | 0.55 | 1.22 |
| 1325 | NM_001302 | CORT | −2.15 | −3.10 | 0.726 | 0.53 | 1.36 |
| 64506 | NM_030594 | CPEB1 | −1.60 | −1.93 | 0.743 | 0.70 | 1.06 |
| 1369 | NM_001308 | CPN1 | −1.87 | −0.86 | 0.701 | 0.87 | 0.81 |
| 1370 | J05158 | CPN2 | −1.61 | −1.29 | 0.705 | 0.77 | 0.92 |
| 58487 | NM_021212 | CREBZF | −2.50 | −1.40 | 0.668 | 0.73 | 0.92 |
| 9282 | NM_004229 | CRSP2 | −2.48 | −1.88 | 0.690 | 0.71 | 0.98 |
| 9441 | NM_004831 | CRSP7 | −3.43 | −2.36 | 0.570 | 0.63 | 0.90 |
| 1436 | NM_005211 | CSF1R | −1.85 | −2.13 | 0.730 | 0.71 | 1.03 |
| 1446 | NM_001890 | CSN1S1 | −1.61 | −2.03 | 0.646 | 0.68 | 0.95 |
| 1459 | NM_001896 | CSNK2A2 | −2.56 | −2.32 | 0.627 | 0.68 | 0.92 |
| 80777 | NM_030579 | CYB5B | −1.68 | −1.91 | 0.691 | 0.66 | 1.05 |
| 1545 | NM_000104 | CYP1B1 | −2.01 | −0.30 | 0.724 | 0.95 | 0.76 |
| 1595 | NM_000786 | CYP51A1 | −1.66 | −2.44 | 0.651 | 0.61 | 1.06 |
| 153090 | NM_032552 | DAB2IP | −3.29 | −2.88 | 0.491 | 0.55 | 0.89 |
| 23142 | NM_015115 | DCUN1D4 | −1.71 | −0.53 | 0.726 | 0.92 | 0.79 |
| 245932 | NM_153289 | DEFB119 | −1.78 | −1.33 | 0.721 | 0.77 | 0.93 |
| 140850 | NM_139074 | DEFB127 | −2.20 | −1.40 | 0.609 | 0.79 | 0.77 |
| 1676 | NM_004401 | DFFA | −2.36 | −1.36 | 0.620 | 0.79 | 0.78 |
| 10901 | NM_021004 | DHRS4 | −2.40 | −1.05 | 0.653 | 0.83 | 0.79 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 79665 | NM_024612 | DHX40 | −3.28 | −3.35 | 0.433 | 0.48 | 0.90 |
| 27122 | NM_013253 | DKK3 | −2.46 | −2.37 | 0.565 | 0.63 | 0.89 |
| 1750 | XM_376652 | DLX6 | −2.60 | −2.26 | 0.655 | 0.56 | 1.17 |
| 29958 | NM_013391 | DMGDH | −3.45 | −2.47 | 0.661 | 0.55 | 1.20 |
| 1763 | XM_166103 | DNA2L | −2.54 | −2.55 | 0.463 | 0.59 | 0.78 |
| 1788 | NM_022552 | DNMT3A | −1.70 | −2.24 | 0.728 | 0.65 | 1.11 |
| 116092 | NM_052951 | DNTTIP1 | −1.71 | −1.22 | 0.692 | 0.78 | 0.89 |
| 220164 | NM_152721 | DOK6 | −2.81 | −1.66 | 0.556 | 0.72 | 0.78 |
| 29980 | NM_145794 | DONSON | −4.14 | −3.46 | 0.268 | 0.46 | 0.58 |
| 1802 | NM_001384 | DPH2 | −1.91 | −1.63 | 0.589 | 0.74 | 0.80 |
| 10231 | NM_005822 | DSCR1L1 | −1.52 | −1.97 | 0.632 | 0.68 | 0.93 |
| 1837 | NM_001390 | DTNA | −1.52 | −1.54 | 0.667 | 0.77 | 0.87 |
| 151636 | NM_138287 | DTX3L | −1.89 | −1.78 | 0.707 | 0.72 | 0.98 |
| 64118 | NM_022156 | DUS1L | −2.02 | −0.85 | 0.662 | 0.86 | 0.77 |
| 1852 | NM_001395 | DUSP9 | −2.13 | −1.70 | 0.685 | 0.72 | 0.95 |
| 143241 | NM_138812 | DYDC1 | −1.82 | −1.12 | 0.676 | 0.83 | 0.82 |
| 84332 | NM_032372 | DYDC2 | −1.66 | −0.96 | 0.687 | 0.84 | 0.81 |
| 1781 | NM_001378 | DYNC1I2 | −2.06 | −1.72 | 0.732 | 0.74 | 0.98 |
| 1894 | NM_018098 | ECT2 | −2.13 | −0.93 | 0.733 | 0.85 | 0.86 |
| 1915 | NM_001402 | EEF1A1 | −2.11 | −1.76 | 0.620 | 0.69 | 0.90 |
| 29904 | NM_013302 | EEF2K | −2.93 | −2.83 | 0.570 | 0.61 | 0.93 |
| 60678 | NM_021937 | EEFSEC | −1.98 | −0.93 | 0.666 | 0.84 | 0.79 |
| 283229 | NM_173584 | EFCAB4A | −2.38 | −2.66 | 0.494 | 0.47 | 1.05 |
| 65989 | NM_023932 | EGFL9 | −1.74 | −0.45 | 0.715 | 0.93 | 0.77 |
| 112399 | NM_022073 | EGLN3 | −1.61 | −1.82 | 0.678 | 0.72 | 0.94 |
| 8668 | NM_003757 | EIF3S2 | −2.76 | −1.95 | 0.729 | 0.65 | 1.13 |
| 63036 | NM_033440 | ELA2A | −1.51 | −0.80 | 0.745 | 0.87 | 0.86 |
| 1996 | NM_021952 | ELAVL4 | −2.31 | −1.77 | 0.583 | 0.68 | 0.85 |
| 1999 | NM_004433 | ELF3 | −1.90 | −1.53 | 0.749 | 0.70 | 1.07 |
| 256364 | NM_153265 | EML3 | −1.86 | −2.27 | 0.621 | 0.54 | 1.16 |
| 2047 | NM_004441 | EPHB1 | −2.11 | −1.45 | 0.688 | 0.80 | 0.86 |
| 2066 | NM_005235 | ERBB4 | −1.74 | −2.36 | 0.743 | 0.68 | 1.10 |
| 2077 | NM_006494 | ERF | −2.70 | −1.18 | 0.641 | 0.77 | 0.83 |
| 90332 | NM_138568 | EXOC3L2 | −2.04 | −1.45 | 0.591 | 0.79 | 0.75 |
| 5394 | NM_002685 | EXOSC10 | −2.43 | −2.01 | 0.518 | 0.67 | 0.77 |
| 3995 | NM_021727 | FADS3 | −1.73 | −1.79 | 0.653 | 0.73 | 0.90 |
| 11170 | NM_007177 | FAM107A | −2.39 | −1.05 | 0.660 | 0.83 | 0.80 |
| 26071 | NM_015582 | FAM127B | −2.09 | −2.47 | 0.670 | 0.60 | 1.11 |
| 80097 | NM_025029 | FAM128B | −1.75 | −1.31 | 0.680 | 0.77 | 0.88 |
| 9715 | NM_014690 | FAM131B | −1.82 | −3.96 | 0.599 | 0.28 | 2.17 |
| 83982 | NM_032036 | FAM14A | −1.53 | −0.98 | 0.712 | 0.83 | 0.86 |
| 54801 | NM_017645 | FAM29A | −2.20 | −1.54 | 0.633 | 0.79 | 0.80 |
| 26240 | NM_012135 | FAM50B | −2.43 | −1.62 | 0.618 | 0.73 | 0.84 |
| 286336 | NM_033387 | FAM78A | −1.82 | −1.22 | 0.668 | 0.82 | 0.81 |
| 84985 | NM_032899 | FAM83A | −3.11 | −2.64 | 0.490 | 0.52 | 0.94 |
| 2176 | NM_000136 | FANCC | −1.61 | −1.61 | 0.709 | 0.71 | 1.00 |
| 2178 | NM_021922 | FANCE | −2.19 | −2.26 | 0.600 | 0.59 | 1.01 |
| 2197 | NM_001997 | FAU | −3.01 | −1.72 | 0.641 | 0.72 | 0.89 |
| 54850 | NM_017703 | FBXL12 | −1.60 | −0.42 | 0.748 | 0.94 | 0.80 |
| 283807 | NM_203373 | FBXL22 | −1.74 | −0.84 | 0.640 | 0.82 | 0.78 |
| 93611 | NM_033182 | FBXO44 | −2.30 | −2.46 | 0.570 | 0.65 | 0.88 |
| 26270 | NM_018438 | FBXO6 | −2.11 | −1.31 | 0.688 | 0.79 | 0.87 |
| 6468 | NM_022039 | FBXW4 | −2.27 | −0.91 | 0.661 | 0.85 | 0.78 |
| 2213 | NM_004001 | FCGR2B | −2.14 | −1.74 | 0.724 | 0.74 | 0.98 |
| 2222 | NM_004462 | FDFT1 | −2.11 | −1.52 | 0.663 | 0.77 | 0.86 |
| 2865 | NM_005304 | FFAR3 | −1.56 | −0.97 | 0.714 | 0.85 | 0.84 |
| 2268 | NM_005248 | FGR | −2.67 | −2.20 | 0.610 | 0.70 | 0.87 |
| 84929 | NM_032843 | FIBCD1 | −2.44 | −1.47 | 0.598 | 0.73 | 0.82 |
| 80099 | NM_025031 | FLJ21075 | −2.44 | −2.10 | 0.553 | 0.63 | 0.88 |
| 80154 | NM_025084 | FLJ22795 | −2.79 | −2.57 | 0.493 | 0.54 | 0.91 |
| 220042 | NM_145018 | FLJ25416 | −2.57 | −2.05 | 0.594 | 0.65 | 0.91 |
| 254048 | XM_376679 | FLJ25778 | −2.90 | −2.67 | 0.543 | 0.55 | 0.99 |
| 152756 | NM_153027 | FLJ31659 | −2.26 | −1.93 | 0.652 | 0.70 | 0.93 |
| 201283 | NM_153032 | FLJ32065 | −2.17 | −1.88 | 0.657 | 0.69 | 0.96 |
| 400629 | NM_207459 | FLJ35767 | −2.91 | −2.91 | 0.458 | 0.49 | 0.94 |
| 168455 | NM_175884 | FLJ36031 | −2.00 | −1.95 | 0.653 | 0.69 | 0.94 |
| 151258 | NM_173512 | FLJ39822 | −1.66 | −0.46 | 0.744 | 0.93 | 0.80 |
| 147699 | NM_178494 | FLJ40125 | −1.65 | −1.34 | 0.708 | 0.80 | 0.88 |
| 206338 | NM_173800 | FLJ90650 | −1.90 | −0.72 | 0.702 | 0.87 | 0.81 |
| 2324 | NM_002020 | FLT4 | −1.85 | −0.86 | 0.729 | 0.88 | 0.83 |
| 8061 | NM_005438 | FOSL1 | −2.05 | −0.85 | 0.727 | 0.83 | 0.87 |
| 2300 | NM_005250 | FOXL1 | −2.14 | −1.86 | 0.716 | 0.63 | 1.13 |
| 116113 | NM_138457 | FOXP4 | −1.63 | −1.72 | 0.693 | 0.75 | 0.92 |
| 53826 | NM_022003 | FXYD6 | −1.58 | −2.08 | 0.742 | 0.71 | 1.04 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 2585 | NM_002044 | GALK2 | −2.75 | −2.39 | 0.598 | 0.67 | 0.89 |
| 253959 | XM_210022 | GARNL1 | −1.67 | −1.34 | 0.737 | 0.77 | 0.95 |
| 2618 | NM_000819 | GART | −2.28 | −1.56 | 0.713 | 0.69 | 1.03 |
| 2633 | NM_002053 | GBP1 | −2.12 | −3.02 | 0.711 | 0.52 | 1.36 |
| 2657 | NM_001492 | GDF1 | −1.98 | −2.39 | 0.748 | 0.64 | 1.17 |
| 124975 | NM_153338 | GGT6 | −1.99 | −2.23 | 0.647 | 0.69 | 0.94 |
| 168537 | NM_153236 | GIMAP7 | −2.20 | −1.13 | 0.620 | 0.82 | 0.76 |
| 256356 | NM_152776 | GK5 | −2.15 | −1.51 | 0.546 | 0.69 | 0.79 |
| 83468 | NM_031302 | GLT8D2 | −2.03 | −1.69 | 0.616 | 0.72 | 0.85 |
| 10691 | NM_006582 | GMEB1 | −2.09 | −1.57 | 0.723 | 0.69 | 1.04 |
| 94235 | NM_033258 | GNG8 | −1.55 | −1.78 | 0.689 | 0.73 | 0.94 |
| 27238 | NM_015698 | GPKOW | −1.68 | −0.44 | 0.700 | 0.93 | 0.75 |
| 283554 | XM_290615 | GPR137C | −2.18 | −1.55 | 0.513 | 0.68 | 0.75 |
| 390212 | NM_206997 | GPR152 | −1.97 | −1.51 | 0.627 | 0.73 | 0.86 |
| 2846 | NM_005296 | GPR23 | −1.73 | −1.57 | 0.682 | 0.75 | 0.91 |
| 2852 | NM_001505 | GPR30 | −1.85 | −1.10 | 0.661 | 0.82 | 0.80 |
| 2853 | NM_005299 | GPR31 | −1.71 | −1.04 | 0.687 | 0.84 | 0.82 |
| 2854 | NM_001506 | GPR32 | −1.77 | −2.67 | 0.675 | 0.59 | 1.14 |
| 2866 | NM_005305 | GPR42 | −1.69 | −0.86 | 0.690 | 0.87 | 0.80 |
| 10149 | NM_005756 | GPR64 | −1.60 | −1.69 | 0.705 | 0.74 | 0.95 |
| 53831 | NM_020370 | GPR84 | −2.09 | −1.84 | 0.615 | 0.71 | 0.86 |
| 53836 | NM_023915 | GPR87 | −1.90 | −2.10 | 0.653 | 0.67 | 0.98 |
| 285513 | NM_198281 | GPRIN3 | −1.62 | −2.88 | 0.705 | 0.58 | 1.21 |
| 80852 | XM_042936 | GRIP2 | −2.15 | −2.41 | 0.610 | 0.57 | 1.08 |
| 2926 | NM_002092 | GRSF1 | −1.83 | −1.95 | 0.604 | 0.71 | 0.85 |
| 84163 | NM_173537 | GTF2IRD2 | −1.55 | −1.00 | 0.669 | 0.85 | 0.79 |
| 26164 | NM_015666 | GTPBP5 | −2.03 | −1.11 | 0.681 | 0.82 | 0.83 |
| 2978 | NM_000409 | GUCA1A | −1.51 | −1.53 | 0.704 | 0.75 | 0.94 |
| 3000 | NM_000180 | GUCY2D | −2.59 | −1.81 | 0.620 | 0.75 | 0.82 |
| 60484 | NM_021817 | HAPLN2 | −1.85 | −1.02 | 0.687 | 0.83 | 0.83 |
| 253018 | NM_181717 | HCG27 | −2.47 | −1.40 | 0.611 | 0.76 | 0.80 |
| 57493 | XM_087386 | HEG1 | −2.41 | −1.43 | 0.610 | 0.78 | 0.78 |
| 3280 | NM_005524 | HES1 | −1.52 | −1.64 | 0.673 | 0.75 | 0.90 |
| 57801 | NM_021170 | HES4 | −2.53 | −2.94 | 0.455 | 0.57 | 0.80 |
| 135114 | NM_138571 | HINT3 | −1.60 | −1.56 | 0.675 | 0.74 | 0.91 |
| 3093 | NM_005339 | HIP2 | −2.23 | −2.50 | 0.711 | 0.63 | 1.13 |
| 8479 | NM_003609 | HIRIP3 | −1.76 | −1.71 | 0.665 | 0.72 | 0.92 |
| 23262 | NM_015216 | HISPPD1 | −2.01 | −0.62 | 0.744 | 0.88 | 0.85 |
| 121504 | NM_175054 | HIST4H4 | −2.04 | −2.20 | 0.640 | 0.69 | 0.93 |
| 3099 | NM_000189 | HK2 | −2.19 | −1.49 | 0.678 | 0.80 | 0.85 |
| 3146 | NM_002128 | HMGB1 | −1.91 | −1.64 | 0.722 | 0.77 | 0.94 |
| 3156 | NM_000859 | HMGCR | −2.02 | −1.24 | 0.743 | 0.75 | 0.99 |
| 3150 | NM_004965 | HMGN1 | −1.80 | −1.16 | 0.654 | 0.81 | 0.81 |
| 220988 | NM_194247 | HNRPA3 | −2.18 | −2.51 | 0.656 | 0.58 | 1.14 |
| 50863 | NM_016522 | HNT | −1.81 | −2.15 | 0.611 | 0.69 | 0.89 |
| 84525 | NM_032495 | HOP | −1.53 | −0.26 | 0.748 | 0.96 | 0.78 |
| 3238 | NM_021193 | HOXD12 | −2.65 | −2.00 | 0.675 | 0.62 | 1.09 |
| 154791 | NM_197964 | HSPC268 | −3.61 | −2.71 | 0.441 | 0.57 | 0.78 |
| 23553 | NM_012269 | HYAL4 | −3.54 | −2.99 | 0.444 | 0.52 | 0.86 |
| 3382 | NM_004968 | ICA1 | −1.70 | −1.41 | 0.659 | 0.78 | 0.84 |
| 23463 | NM_012405 | ICMT | −1.81 | −0.73 | 0.708 | 0.88 | 0.81 |
| 3467 | NM_002177 | IFNW1 | −2.83 | −1.85 | 0.636 | 0.72 | 0.88 |
| 3543 | NM_020070 | IGLL1 | −1.72 | −0.92 | 0.666 | 0.85 | 0.78 |
| 3550 | NM_006083 | IK | −4.13 | −3.31 | 0.469 | 0.50 | 0.93 |
| 3596 | NM_002188 | IL13 | −1.72 | −1.81 | 0.666 | 0.71 | 0.94 |
| 3601 | NM_002189 | IL15RA | −2.13 | −2.03 | 0.725 | 0.69 | 1.05 |
| 3553 | NM_000576 | IL1B | −2.98 | −2.49 | 0.617 | 0.62 | 0.99 |
| 3611 | NM_004517 | ILK | −2.18 | −1.69 | 0.568 | 0.73 | 0.77 |
| 55364 | NM_018439 | IMPACT | −1.68 | −2.16 | 0.634 | 0.68 | 0.93 |
| 3619 | NM_020238 | INCENP | −3.05 | −3.25 | 0.386 | 0.51 | 0.76 |
| 26173 | XM_291222 | INTS1 | −1.88 | −1.39 | 0.704 | 0.77 | 0.91 |
| 57508 | NM_020748 | INTS2 | −2.14 | −0.99 | 0.654 | 0.85 | 0.77 |
| 79711 | NM_024658 | IPO4 | −1.53 | −1.42 | 0.732 | 0.78 | 0.94 |
| 79192 | XM_380171 | IRX1 | −2.16 | −1.71 | 0.628 | 0.74 | 0.85 |
| 122961 | NM_194279 | ISCA2 | −1.58 | −1.79 | 0.719 | 0.75 | 0.95 |
| 23479 | NM_014301 | ISCU | −2.62 | −1.60 | 0.589 | 0.74 | 0.79 |
| 3713 | NM_005547 | IVL | −1.73 | −1.61 | 0.653 | 0.75 | 0.87 |
| 126306 | NM_144616 | JSRP1 | −1.72 | −2.33 | 0.690 | 0.67 | 1.02 |
| 353219 | NM_181337 | KAAG1 | −1.55 | −1.04 | 0.709 | 0.81 | 0.87 |
| 126823 | NM_152366 | KARCA1 | −1.57 | −0.86 | 0.718 | 0.88 | 0.81 |
| 3780 | NM_002248 | KCNN1 | −1.64 | −0.72 | 0.668 | 0.89 | 0.75 |
| 3785 | NM_004518 | KCNQ2 | −2.29 | −1.30 | 0.734 | 0.79 | 0.93 |
| 9132 | NM_004700 | KCNQ4 | −2.43 | −1.89 | 0.709 | 0.69 | 1.03 |
| 283518 | NM_173605 | KCNRG | −1.82 | −1.50 | 0.621 | 0.70 | 0.88 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 57582 | XM_029962 | KCNT1 | -2.28 | -2.42 | 0.726 | 0.60 | 1.21 |
| 202559 | NM_152688 | KHDRBS2 | -2.54 | -2.08 | 0.601 | 0.64 | 0.93 |
| 23334 | NM_015284 | KIAA0467 | -1.60 | -0.88 | 0.740 | 0.86 | 0.86 |
| 23354 | XM_049237 | KIAA0841 | -2.55 | -1.54 | 0.595 | 0.75 | 0.79 |
| 23383 | XM_048457 | KIAA0892 | -1.62 | -0.89 | 0.739 | 0.86 | 0.86 |
| 23379 | XM_029101 | KIAA0947 | -2.87 | -2.25 | 0.545 | 0.64 | 0.85 |
| 23325 | NM_015275 | KIAA1033 | -1.95 | -0.59 | 0.690 | 0.91 | 0.76 |
| 57179 | NM_020444 | KIAA1191 | -1.99 | -1.20 | 0.676 | 0.82 | 0.83 |
| 57535 | NM_020775 | KIAA1324 | -2.62 | -1.57 | 0.574 | 0.76 | 0.76 |
| 57650 | NM_020890 | KIAA1524 | -1.65 | -0.95 | 0.722 | 0.84 | 0.86 |
| 80256 | NM_025182 | KIAA1539 | -1.78 | -1.41 | 0.677 | 0.75 | 0.90 |
| 57703 | XM_034594 | KIAA1604 | -2.57 | -2.89 | 0.566 | 0.51 | 1.12 |
| 165215 | NM_177454 | KIAA1946 | -1.61 | -1.30 | 0.719 | 0.80 | 0.90 |
| 3832 | NM_004523 | KIF11 | -4.90 | -3.56 | 0.267 | 0.42 | 0.64 |
| 113220 | NM_138424 | KIF12 | -3.83 | -2.76 | 0.429 | 0.55 | 0.78 |
| 81930 | NM_031217 | KIF18A | -3.12 | -2.18 | 0.532 | 0.64 | 0.82 |
| 9493 | NM_004856 | KIF23 | -3.15 | -2.68 | 0.530 | 0.57 | 0.94 |
| 57565 | NM_020805 | KLHL14 | -1.71 | -1.11 | 0.710 | 0.81 | 0.88 |
| 57563 | NM_020803 | KLHL8 | -2.16 | -1.73 | 0.636 | 0.71 | 0.90 |
| 25818 | NM_012427 | KLK5 | -2.11 | -2.03 | 0.669 | 0.68 | 0.99 |
| 11202 | NM_007196 | KLK8 | -2.18 | -0.72 | 0.689 | 0.88 | 0.79 |
| 3837 | NM_002265 | KPNB1 | -3.32 | -2.97 | 0.384 | 0.47 | 0.81 |
| 3887 | NM_002281 | KRT81 | -2.14 | -2.40 | 0.587 | 0.61 | 0.96 |
| 3857 | NM_000226 | KRT9 | -1.68 | -1.55 | 0.672 | 0.75 | 0.90 |
| 81851 | NM_030967 | KRTAP1-1 | -1.73 | -1.62 | 0.683 | 0.71 | 0.96 |
| 337959 | NM_181621 | KRTAP13-2 | -2.33 | -2.54 | 0.615 | 0.63 | 0.98 |
| 3916 | NM_005561 | LAMP1 | -1.60 | -1.47 | 0.678 | 0.78 | 0.87 |
| 353139 | NM_178428 | LCE2A | -1.82 | -1.26 | 0.659 | 0.77 | 0.86 |
| 79143 | NM_024298 | LENG4 | -2.71 | -2.73 | 0.475 | 0.56 | 0.85 |
| 114783 | XM_055866 | LMTK3 | -1.79 | -0.97 | 0.646 | 0.84 | 0.77 |
| 146325 | NM_145270 | LOC146325 | -1.84 | -1.93 | 0.673 | 0.71 | 0.94 |
| 147646 | XM_085833 | LOC147646 | -1.50 | -1.24 | 0.734 | 0.82 | 0.89 |
| 150223 | XM_097886 | LOC150223 | -2.43 | -1.33 | 0.624 | 0.79 | 0.79 |
| 161247 | NM_203402 | LOC161247 | -2.02 | -1.04 | 0.688 | 0.84 | 0.82 |
| 196264 | NM_198275 | LOC196264 | -1.62 | -2.03 | 0.720 | 0.68 | 1.06 |
| 283152 | XM_378314 | LOC283152 | -1.83 | -2.30 | 0.591 | 0.53 | 1.11 |
| 283547 | XM_378454 | LOC283547 | -2.22 | -1.59 | 0.507 | 0.67 | 0.76 |
| 283871 | XM_208887 | LOC283871 | -1.52 | -1.01 | 0.666 | 0.79 | 0.84 |
| 339745 | NM_001001664 | LOC339745 | -1.63 | -3.03 | 0.726 | 0.55 | 1.31 |
| 374973 | XM_371248 | LOC374973 | -2.30 | -1.67 | 0.572 | 0.70 | 0.82 |
| 399947 | NM_207645 | LOC399947 | -1.73 | -2.10 | 0.676 | 0.63 | 1.07 |
| 400451 | NM_207446 | LOC400451 | -1.79 | -2.58 | 0.665 | 0.55 | 1.22 |
| 90120 | XM_379680 | LOC90120 | -1.53 | -0.65 | 0.693 | 0.91 | 0.76 |
| 4023 | NM_000237 | LPL | -1.88 | -2.27 | 0.742 | 0.64 | 1.15 |
| 84918 | NM_032832 | LRP11 | -1.57 | -1.14 | 0.703 | 0.80 | 0.88 |
| 10128 | NM_133259 | LRPPRC | -1.84 | -1.10 | 0.734 | 0.85 | 0.87 |
| 9684 | NM_014665 | LRRC14 | -1.59 | -1.60 | 0.694 | 0.74 | 0.94 |
| 55631 | NM_017768 | LRRC40 | -1.85 | -1.37 | 0.642 | 0.78 | 0.82 |
| 115353 | NM_052940 | LRRC42 | -1.82 | -0.93 | 0.661 | 0.87 | 0.76 |
| 116064 | XM_057296 | LRRC58 | -2.54 | -3.12 | 0.516 | 0.55 | 0.93 |
| 65999 | NM_023942 | LRRC61 | -1.88 | -1.97 | 0.690 | 0.69 | 1.00 |
| 51599 | NM_015925 | LSR | -2.61 | -2.86 | 0.501 | 0.53 | 0.94 |
| 55692 | NM_018032 | LUC7L | -1.61 | -1.34 | 0.644 | 0.81 | 0.80 |
| 66004 | NM_177477 | LYNX1 | -2.42 | -2.71 | 0.597 | 0.58 | 1.04 |
| 116068 | XM_371760 | LYSMD3 | -2.17 | -1.99 | 0.583 | 0.71 | 0.82 |
| 4101 | NM_005361 | MAGEA2 | -2.02 | -2.23 | 0.593 | 0.66 | 0.90 |
| 9175 | NM_004721 | MAP3K13 | -1.50 | -0.83 | 0.697 | 0.87 | 0.80 |
| 5594 | NM_002745 | MAPK1 | -1.57 | -0.52 | 0.683 | 0.91 | 0.75 |
| 225689 | NM_139021 | MAPK15 | -1.74 | -0.67 | 0.744 | 0.91 | 0.82 |
| 23031 | XM_038150 | MAST3 | -1.53 | -1.52 | 0.705 | 0.75 | 0.93 |
| 4147 | NM_002380 | MATN2 | -1.79 | -2.39 | 0.639 | 0.64 | 1.00 |
| 4149 | NM_002382 | MAX | -1.53 | -1.29 | 0.700 | 0.79 | 0.88 |
| 4152 | NM_002384 | MBD1 | -2.24 | -0.88 | 0.725 | 0.83 | 0.87 |
| 125997 | NM_144614 | MBD3L2 | -1.88 | -1.67 | 0.664 | 0.77 | 0.86 |
| 4199 | NM_002395 | ME1 | -2.62 | -1.81 | 0.669 | 0.64 | 1.05 |
| 4200 | NM_002396 | ME2 | -1.52 | -0.99 | 0.694 | 0.85 | 0.82 |
| 4201 | NM_014623 | MEA1 | -1.59 | -1.92 | 0.679 | 0.71 | 0.96 |
| 84246 | NM_032286 | MED10 | -1.54 | -1.68 | 0.708 | 0.73 | 0.97 |
| 80306 | NM_025205 | MED28 | -2.77 | -2.63 | 0.497 | 0.53 | 0.94 |
| 10001 | NM_005466 | MED6 | -2.01 | -1.99 | 0.748 | 0.69 | 1.08 |
| 112950 | NM_052877 | MED8 | -2.06 | -2.20 | 0.602 | 0.64 | 0.93 |
| 1953 | XM_031401 | MEGF6 | -2.16 | -1.92 | 0.528 | 0.69 | 0.76 |
| 4225 | NM_005925 | MEP1B | -2.09 | -1.54 | 0.600 | 0.75 | 0.80 |
| 59274 | NM_022566 | MESDC1 | -1.81 | -0.93 | 0.653 | 0.85 | 0.77 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 23184 | XM_370880 | MESDC2 | -2.08 | -1.53 | 0.602 | 0.75 | 0.81 |
| 4236 | NM_005926 | MFAP1 | -2.75 | -3.08 | 0.447 | 0.53 | 0.84 |
| 84310 | NM_032350 | MGC11257 | -1.65 | -1.37 | 0.688 | 0.77 | 0.89 |
| 94107 | NM_053045 | MGC14327 | -2.77 | -3.16 | 0.471 | 0.55 | 0.86 |
| 84848 | NM_032762 | MGC16121 | -1.64 | -1.11 | 0.732 | 0.80 | 0.92 |
| 93624 | XM_291105 | MGC21874 | -1.95 | -2.84 | 0.628 | 0.59 | 1.07 |
| 200424 | XM_371501 | MGC22014 | -1.61 | -1.03 | 0.721 | 0.83 | 0.86 |
| 84730 | NM_032644 | MGC2452 | -1.56 | -1.67 | 0.746 | 0.70 | 1.07 |
| 169166 | NM_152628 | MGC39715 | -1.68 | -1.66 | 0.712 | 0.74 | 0.96 |
| 84752 | NM_033309 | MGC4655 | -2.75 | -1.72 | 0.548 | 0.69 | 0.80 |
| 202915 | NM_152689 | MGC9712 | -2.69 | -1.98 | 0.575 | 0.67 | 0.86 |
| 2872 | NM_017572 | MKNK2 | -1.89 | -1.03 | 0.635 | 0.84 | 0.76 |
| 64976 | NM_003776 | MRPL40 | -1.77 | -0.98 | 0.711 | 0.84 | 0.84 |
| 122704 | NM_181307 | MRPL52 | -2.03 | -1.61 | 0.636 | 0.78 | 0.82 |
| 65005 | NM_031420 | MRPL9 | -1.50 | -0.13 | 0.747 | 0.97 | 0.77 |
| 64951 | NM_032014 | MRPS24 | -1.72 | -0.67 | 0.712 | 0.89 | 0.80 |
| 10903 | NM_181873 | MTMR11 | -2.10 | -1.54 | 0.693 | 0.75 | 0.93 |
| 4609 | NM_002467 | MYC | -2.13 | -1.70 | 0.740 | 0.67 | 1.11 |
| 4624 | NM_002471 | MYH6 | -1.77 | -0.79 | 0.731 | 0.89 | 0.82 |
| 4635 | NM_002476 | MYL4 | -2.43 | -1.77 | 0.708 | 0.71 | 1.00 |
| 85366 | NM_033118 | MYLK2 | -1.59 | -0.91 | 0.698 | 0.86 | 0.81 |
| 23026 | XM_028522 | MYO16 | -1.91 | -1.26 | 0.700 | 0.80 | 0.88 |
| 4666 | NM_005594 | NACA | -1.55 | -1.48 | 0.740 | 0.78 | 0.95 |
| 23148 | XM_166571 | NACAD | -2.13 | -1.70 | 0.662 | 0.73 | 0.91 |
| 54187 | NM_018946 | NANS | -1.77 | -1.28 | 0.694 | 0.82 | 0.84 |
| 23397 | NM_015341 | NCAPH | -1.94 | -1.74 | 0.690 | 0.72 | 0.96 |
| 23154 | NM_014284 | NCDN | -2.18 | -1.76 | 0.655 | 0.72 | 0.91 |
| 56926 | NM_020170 | NCLN | -4.19 | -3.59 | 0.320 | 0.44 | 0.72 |
| 4536 | NM_173709 | ND2 | -1.53 | -1.67 | 0.694 | 0.74 | 0.93 |
| 54820 | NM_017668 | NDE1 | -3.86 | -3.41 | 0.260 | 0.44 | 0.60 |
| 81565 | NM_030808 | NDEL1 | -1.84 | -1.52 | 0.649 | 0.75 | 0.87 |
| 27158 | NM_014434 | NDOR1 | -1.79 | -0.76 | 0.680 | 0.88 | 0.77 |
| 10397 | NM_006096 | NDRG1 | -1.87 | -1.21 | 0.641 | 0.80 | 0.80 |
| 55967 | NM_018838 | NDUFA12 | -1.51 | -1.77 | 0.669 | 0.73 | 0.91 |
| 4700 | NM_002490 | NDUFA6 | -1.84 | -0.86 | 0.691 | 0.87 | 0.79 |
| 4707 | NM_004545 | NDUFB1 | -2.24 | -1.69 | 0.623 | 0.75 | 0.83 |
| 4734 | NM_006154 | NEDD4 | -1.85 | -1.64 | 0.726 | 0.73 | 0.99 |
| 79858 | NM_024800 | NEK11 | -1.58 | -0.52 | 0.695 | 0.92 | 0.75 |
| 284086 | NM_178170 | NEK8 | -2.10 | -1.77 | 0.587 | 0.73 | 0.80 |
| 349565 | NM_178177 | NMNAT3 | -1.93 | -1.14 | 0.687 | 0.83 | 0.82 |
| 283820 | NM_173614 | NOMO2 | -1.62 | -1.17 | 0.664 | 0.76 | 0.87 |
| 9520 | NM_006310 | NPEPPS | -2.82 | -2.20 | 0.613 | 0.65 | 0.94 |
| 23467 | NM_014293 | NPTXR | -1.90 | -1.63 | 0.732 | 0.73 | 1.00 |
| 2494 | NM_003822 | NR5A2 | -2.24 | -2.51 | 0.720 | 0.61 | 1.18 |
| 80023 | NM_024958 | NRSN2 | -1.60 | -0.46 | 0.716 | 0.92 | 0.78 |
| 25936 | NM_015471 | NSL1 | -1.66 | -0.13 | 0.739 | 0.98 | 0.76 |
| 4923 | NM_002531 | NTSR1 | -1.93 | -2.23 | 0.633 | 0.63 | 1.00 |
| 170685 | NM_153183 | NUDT10 | -1.73 | -1.57 | 0.700 | 0.75 | 0.93 |
| 11051 | NM_007006 | NUDT21 | -2.43 | -1.19 | 0.652 | 0.80 | 0.81 |
| 23279 | XM_113678 | NUP160 | -2.11 | -1.27 | 0.666 | 0.80 | 0.84 |
| 4928 | NM_005387 | NUP98 | -2.55 | -2.58 | 0.694 | 0.58 | 1.20 |
| 55916 | NM_018698 | NXT2 | -2.18 | -2.94 | 0.517 | 0.57 | 0.91 |
| 11054 | NM_007346 | OGFR | -2.00 | -1.99 | 0.749 | 0.69 | 1.08 |
| 611 | NM_001708 | OPN1SW | -2.05 | -2.27 | 0.605 | 0.63 | 0.96 |
| 10133 | NM_021980 | OPTN | -1.65 | -2.10 | 0.683 | 0.65 | 1.05 |
| 4991 | NM_002548 | OR1D2 | -1.53 | -1.59 | 0.706 | 0.74 | 0.96 |
| 8387 | NM_003553 | OR1E1 | -1.97 | -2.21 | 0.621 | 0.64 | 0.97 |
| 26211 | NM_012369 | OR2F1 | -1.86 | -2.11 | 0.653 | 0.66 | 0.99 |
| 114881 | NM_017731 | OSBPL7 | -1.55 | -1.46 | 0.688 | 0.78 | 0.88 |
| 64172 | NM_022353 | OSGEPL1 | -1.75 | -0.39 | 0.709 | 0.94 | 0.75 |
| 150677 | NM_148961 | OTOS | -2.80 | -1.96 | 0.567 | 0.68 | 0.83 |
| 27199 | NM_080818 | OXGR1 | -1.87 | -1.27 | 0.657 | 0.80 | 0.82 |
| 27334 | NM_014499 | P2RY10 | -1.61 | -1.34 | 0.695 | 0.78 | 0.89 |
| 8106 | NM_004643 | PABPN1 | -1.54 | -1.07 | 0.705 | 0.82 | 0.86 |
| 85315 | NM_133367 | PAQR8 | -2.37 | -1.44 | 0.612 | 0.74 | 0.83 |
| 344838 | NM_198504 | PAQR9 | -2.02 | -3.47 | 0.667 | 0.49 | 1.35 |
| 5092 | NM_000281 | PCBD1 | -2.10 | -1.88 | 0.596 | 0.69 | 0.87 |
| 57060 | NM_020418 | PCBP4 | -2.01 | -1.02 | 0.700 | 0.86 | 0.82 |
| 5116 | NM_006031 | PCNT | -2.14 | -2.64 | 0.639 | 0.61 | 1.05 |
| 9141 | NM_004708 | PDCD5 | -3.14 | -3.53 | 0.398 | 0.42 | 0.96 |
| 5145 | NM_000440 | PDE6A | -1.80 | -1.28 | 0.655 | 0.79 | 0.83 |
| 8622 | NM_003719 | PDE8B | -2.35 | -0.89 | 0.693 | 0.87 | 0.80 |
| 5159 | NM_002609 | PDGFRB | -1.80 | -1.58 | 0.642 | 0.74 | 0.87 |
| 204474 | NM_174924 | PDILT | -2.98 | -1.71 | 0.530 | 0.70 | 0.75 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/HMLER Ratio |
|---|---|---|---|---|---|---|---|
| 10630 | NM_006474 | PDPN | −1.50 | −1.56 | 0.640 | 0.74 | 0.86 |
| 23037 | NM_015022 | PDZD2 | −1.83 | −0.91 | 0.720 | 0.86 | 0.84 |
| 10455 | NM_006117 | PECI | −1.63 | −1.10 | 0.688 | 0.82 | 0.84 |
| 27043 | NM_014389 | PELP1 | −2.08 | −1.98 | 0.602 | 0.67 | 0.90 |
| 64065 | NM_022121 | PERP | −1.73 | −2.24 | 0.668 | 0.63 | 1.06 |
| 92960 | NM_080662 | PEX11G | −2.18 | −4.07 | 0.585 | 0.41 | 1.42 |
| 5207 | NM_002625 | PFKFB1 | −2.30 | −2.34 | 0.546 | 0.62 | 0.88 |
| 192111 | NM_138575 | PGAM5 | −1.59 | −1.00 | 0.720 | 0.83 | 0.86 |
| 80055 | NM_024989 | PGAP1 | −1.74 | −1.11 | 0.684 | 0.81 | 0.85 |
| 5232 | NM_138733 | PGK2 | −2.53 | −2.32 | 0.501 | 0.63 | 0.80 |
| 221692 | XM_166420 | PHACTR1 | −1.86 | −1.34 | 0.704 | 0.76 | 0.92 |
| 112885 | NM_138415 | PHF21B | −1.51 | −2.39 | 0.697 | 0.64 | 1.09 |
| 84844 | NM_032758 | PHF5A | −2.27 | −1.75 | 0.627 | 0.67 | 0.93 |
| 51588 | NM_015897 | PIAS4 | −2.04 | −1.34 | 0.748 | 0.74 | 1.00 |
| 5291 | NM_006219 | PIK3CB | −1.87 | −1.64 | 0.640 | 0.73 | 0.88 |
| 26034 | NM_015553 | PIP3-E | −1.57 | −0.68 | 0.751 | 0.88 | 0.85 |
| 55124 | NM_018068 | PIWIL2 | −1.75 | −1.21 | 0.665 | 0.80 | 0.83 |
| 168507 | NM_138295 | PKD1L1 | −2.07 | −2.06 | 0.644 | 0.68 | 0.95 |
| 9033 | NM_016112 | PKD2L1 | −1.85 | −1.87 | 0.657 | 0.67 | 0.98 |
| 5570 | NM_032471 | PKIB | −2.34 | −1.95 | 0.538 | 0.69 | 0.78 |
| 123745 | NM_198442 | PLA2G4E | −1.99 | −2.92 | 0.642 | 0.59 | 1.09 |
| 22874 | NM_014935 | PLEKHA6 | −2.09 | −1.04 | 0.697 | 0.83 | 0.84 |
| 58473 | NM_021200 | PLEKHB1 | −1.54 | −0.79 | 0.741 | 0.86 | 0.86 |
| 10979 | NM_006832 | PLEKHC1 | −1.69 | −1.32 | 0.676 | 0.78 | 0.86 |
| 57480 | XM_027307 | PLEKHG1 | −1.60 | −0.94 | 0.742 | 0.85 | 0.87 |
| 5356 | NM_002669 | PLRG1 | −2.11 | −1.42 | 0.738 | 0.78 | 0.95 |
| 5359 | NM_021105 | PLSCR1 | −1.81 | −1.73 | 0.665 | 0.69 | 0.96 |
| 57048 | NM_020360 | PLSCR3 | −1.83 | −1.14 | 0.660 | 0.80 | 0.82 |
| 5373 | NM_000303 | PMM2 | −3.21 | −2.03 | 0.594 | 0.60 | 1.00 |
| 5395 | NM_000535 | PMS2 | −1.83 | −1.79 | 0.735 | 0.74 | 0.99 |
| 25953 | NM_015488 | PNKD | −1.72 | −1.63 | 0.669 | 0.73 | 0.92 |
| 11284 | NM_007254 | PNKP | −1.56 | −1.68 | 0.688 | 0.73 | 0.95 |
| 5430 | NM_000937 | POLR2A | −5.91 | −5.55 | 0.188 | 0.13 | 1.46 |
| 5432 | NM_002694 | POLR2C | −2.85 | −2.66 | 0.523 | 0.61 | 0.86 |
| 5433 | NM_004805 | POLR2D | −5.28 | −2.62 | 0.332 | 0.48 | 0.69 |
| 5438 | NM_006233 | POLR2I | −2.04 | −1.29 | 0.656 | 0.81 | 0.81 |
| 5439 | NM_006234 | POLR2J | −2.71 | −3.22 | 0.544 | 0.52 | 1.04 |
| 246721 | NM_032958 | POLR2J2 | −2.01 | −2.41 | 0.684 | 0.60 | 1.14 |
| 5441 | NM_021128 | POLR2L | −1.95 | −1.19 | 0.672 | 0.83 | 0.81 |
| 171568 | NM_138338 | POLR3H | −2.16 | −2.14 | 0.624 | 0.66 | 0.95 |
| 10940 | NM_015029 | POP1 | −4.24 | −3.02 | 0.390 | 0.50 | 0.78 |
| 5456 | NM_000307 | POU3F4 | −2.32 | −1.82 | 0.713 | 0.65 | 1.10 |
| 5498 | NM_000309 | PPOX | −2.04 | −1.50 | 0.741 | 0.70 | 1.06 |
| 23645 | NM_014330 | PPP1R15A | −2.20 | −1.48 | 0.698 | 0.77 | 0.91 |
| 5534 | NM_000945 | PPP3R1 | −2.89 | −1.67 | 0.603 | 0.74 | 0.82 |
| 343070 | XM_291638 | PRAMEF9 | −2.37 | −1.86 | 0.613 | 0.73 | 0.84 |
| 59336 | NM_021620 | PRDM13 | −2.48 | −2.63 | 0.524 | 0.57 | 0.93 |
| 56978 | NM_020226 | PRDM8 | −1.63 | −1.79 | 0.687 | 0.70 | 0.98 |
| 5550 | NM_002726 | PREP | −1.97 | −1.68 | 0.668 | 0.75 | 0.89 |
| 5553 | NM_002728 | PRG2 | −2.27 | −2.72 | 0.617 | 0.60 | 1.03 |
| 166336 | NM_198859 | PRICKLE2 | −2.13 | −2.68 | 0.632 | 0.58 | 1.09 |
| 5564 | NM_006253 | PRKAB1 | −2.19 | −2.65 | 0.580 | 0.56 | 1.03 |
| 5565 | NM_005399 | PRKAB2 | −1.80 | −1.41 | 0.656 | 0.77 | 0.86 |
| 5567 | NM_002731 | PRKACB | −1.80 | −0.95 | 0.639 | 0.84 | 0.76 |
| 53632 | NM_017431 | PRKAG3 | −1.52 | −1.29 | 0.702 | 0.79 | 0.89 |
| 5617 | NM_000948 | PRL | −2.06 | −1.25 | 0.741 | 0.80 | 0.92 |
| 23627 | NM_012409 | PRND | −2.02 | −2.26 | 0.612 | 0.63 | 0.98 |
| 5625 | NM_016335 | PRODH | −2.35 | −2.40 | 0.702 | 0.52 | 1.34 |
| 58510 | NM_021232 | PRODH2 | −3.37 | −1.97 | 0.574 | 0.61 | 0.94 |
| 8559 | NM_003675 | PRPF18 | −2.48 | −1.27 | 0.652 | 0.82 | 0.80 |
| 27339 | NM_014502 | PRPF19 | −1.79 | −2.09 | 0.682 | 0.68 | 1.01 |
| 26121 | NM_015629 | PRPF31 | −1.88 | −1.33 | 0.639 | 0.78 | 0.82 |
| 5698 | NM_002800 | PSMB9 | −2.94 | −1.80 | 0.627 | 0.64 | 0.98 |
| 5714 | NM_002812 | PSMD8 | −4.26 | −4.07 | 0.182 | 0.33 | 0.55 |
| 5740 | NM_000961 | PTGIS | −2.23 | −0.75 | 0.717 | 0.85 | 0.84 |
| 5757 | NM_002823 | PTMA | −2.62 | −2.15 | 0.571 | 0.63 | 0.91 |
| 5805 | NM_000317 | PTS | −1.50 | −0.92 | 0.738 | 0.84 | 0.88 |
| 9543 | NM_004884 | PUNC | −2.25 | −0.91 | 0.710 | 0.86 | 0.82 |
| 84074 | NM_032134 | QRICH2 | −1.67 | −2.79 | 0.686 | 0.55 | 1.26 |
| 5768 | NM_002826 | QSCN6 | −2.59 | −2.10 | 0.570 | 0.63 | 0.90 |
| 26056 | NM_015470 | RAB11FIP5 | −1.64 | −1.48 | 0.741 | 0.76 | 0.97 |
| 9609 | NM_004914 | RAB36 | −1.95 | −1.94 | 0.747 | 0.71 | 1.05 |
| 338382 | NM_177403 | RAB7B | −1.84 | −1.17 | 0.699 | 0.83 | 0.84 |
| 4218 | NM_005370 | RAB8A | −1.62 | −1.88 | 0.689 | 0.69 | 1.00 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 5876 | NM_004582 | RABGGTB | −2.34 | −1.78 | 0.704 | 0.65 | 1.09 |
| 5885 | NM_006265 | RAD21 | −1.83 | −1.09 | 0.744 | 0.85 | 0.88 |
| 5888 | NM_002875 | RAD51 | −1.87 | −2.50 | 0.722 | 0.59 | 1.22 |
| 10411 | NM_006105 | RAPGEF3 | −2.07 | −1.79 | 0.696 | 0.76 | 0.92 |
| 9462 | NM_004841 | RASAL2 | −2.61 | −2.66 | 0.661 | 0.60 | 1.09 |
| 10235 | NM_005825 | RASGRP2 | −4.38 | −2.56 | 0.419 | 0.50 | 0.84 |
| 8045 | NM_003475 | RASSF7 | −1.74 | −2.48 | 0.722 | 0.62 | 1.16 |
| 10741 | NM_006606 | RBBP9 | −4.88 | −3.74 | 0.190 | 0.35 | 0.54 |
| 79171 | NM_024321 | RBM42 | −1.73 | −1.83 | 0.711 | 0.71 | 1.00 |
| 27303 | NM_014483 | RBMS3 | −1.55 | −1.60 | 0.733 | 0.72 | 1.02 |
| 5950 | NM_006744 | RBP4 | −2.25 | −1.67 | 0.627 | 0.71 | 0.88 |
| 9978 | NM_014248 | RBX1 | −1.94 | −1.42 | 0.715 | 0.77 | 0.93 |
| 9986 | NM_005133 | RCE1 | −2.36 | −1.98 | 0.700 | 0.61 | 1.16 |
| 57333 | NM_020650 | RCN3 | −2.49 | −3.01 | 0.596 | 0.53 | 1.12 |
| 25807 | NM_012265 | RHBDD3 | −1.74 | −1.10 | 0.726 | 0.82 | 0.89 |
| 57127 | NM_020407 | RHBG | −1.83 | −1.13 | 0.699 | 0.83 | 0.85 |
| 391 | NM_001665 | RHOG | −1.61 | −0.56 | 0.738 | 0.91 | 0.81 |
| 171177 | NM_133639 | RHOV | −1.52 | −1.86 | 0.716 | 0.67 | 1.07 |
| 83732 | NM_031480 | RIOK1 | −2.26 | −1.70 | 0.575 | 0.76 | 0.76 |
| 84659 | NM_032572 | RNASE7 | −1.87 | −1.61 | 0.691 | 0.71 | 0.97 |
| 140432 | NM_178861 | RNF113B | −1.76 | −1.42 | 0.643 | 0.78 | 0.83 |
| 79845 | NM_024787 | RNF122 | −2.03 | −1.15 | 0.652 | 0.82 | 0.79 |
| 158763 | NM_144967 | RP13-102H20.1 | −2.11 | −3.99 | 0.673 | 0.37 | 1.84 |
| 6134 | NM_006013 | RPL10 | −1.58 | −2.08 | 0.736 | 0.64 | 1.15 |
| 4736 | NM_007104 | RPL10A | −1.51 | −2.41 | 0.745 | 0.65 | 1.15 |
| 11224 | NM_007209 | RPL35 | −1.83 | −1.69 | 0.701 | 0.73 | 0.96 |
| 6125 | NM_000969 | RPL5 | −1.62 | −2.14 | 0.734 | 0.63 | 1.17 |
| 6217 | NM_001020 | RPS16 | −1.63 | −1.69 | 0.731 | 0.71 | 1.03 |
| 6187 | NM_002952 | RPS2 | −2.72 | −1.81 | 0.676 | 0.70 | 0.96 |
| 6227 | NM_001024 | RPS21 | −3.01 | −1.89 | 0.641 | 0.69 | 0.93 |
| 6188 | NM_001005 | RPS3 | −2.44 | −1.62 | 0.710 | 0.73 | 0.97 |
| 6193 | NM_001009 | RPS5 | −2.80 | −2.12 | 0.666 | 0.65 | 1.02 |
| 6196 | NM_021135 | RPS6KA2 | −1.59 | −1.25 | 0.720 | 0.82 | 0.87 |
| 3921 | NM_002295 | RPSA | −2.47 | −2.35 | 0.654 | 0.62 | 1.06 |
| 64121 | NM_022157 | RRAGC | −1.79 | −1.16 | 0.701 | 0.80 | 0.87 |
| 6240 | NM_001033 | RRM1 | −5.53 | −3.82 | 0.299 | 0.24 | 1.24 |
| 6241 | NM_001034 | RRM2 | −6.12 | −4.07 | 0.226 | 0.19 | 1.18 |
| 54700 | NM_018427 | RRN3 | −2.99 | −1.54 | 0.705 | 0.72 | 0.98 |
| 23212 | NM_015169 | RRS1 | −1.77 | −2.08 | 0.720 | 0.67 | 1.08 |
| 349667 | NM_178570 | RTN4RL2 | −2.87 | −1.66 | 0.596 | 0.73 | 0.82 |
| 860 | NM_004348 | RUNX2 | −2.50 | −1.01 | 0.694 | 0.81 | 0.86 |
| 113174 | NM_138421 | SAAL1 | −1.86 | −1.48 | 0.623 | 0.78 | 0.80 |
| 6299 | NM_002968 | SALL1 | −2.70 | −2.24 | 0.626 | 0.68 | 0.93 |
| 9092 | NM_005146 | SART1 | −1.70 | −0.64 | 0.708 | 0.89 | 0.80 |
| 6307 | NM_006745 | SC4MOL | −2.57 | −1.79 | 0.674 | 0.64 | 1.05 |
| 113178 | NM_079834 | SCAMP4 | −2.18 | −1.71 | 0.559 | 0.74 | 0.75 |
| 92344 | NM_152281 | SCYL1BP1 | −1.65 | −1.53 | 0.688 | 0.78 | 0.88 |
| 6392 | NM_003002 | SDHD | −2.06 | −1.21 | 0.642 | 0.79 | 0.81 |
| 284904 | NM_174977 | SEC14L4 | −1.54 | −1.82 | 0.719 | 0.74 | 0.97 |
| 81929 | NM_031216 | SEH1L | −1.77 | −1.12 | 0.673 | 0.80 | 0.84 |
| 22929 | NM_012247 | SEPHS1 | −1.51 | −0.68 | 0.731 | 0.90 | 0.81 |
| 871 | NM_001235 | SERPINH1 | −2.63 | −0.82 | 0.651 | 0.84 | 0.78 |
| 5274 | NM_005025 | SERPINI1 | −2.31 | −2.56 | 0.702 | 0.62 | 1.13 |
| 54093 | NM_017438 | SETD4 | −2.82 | −2.84 | 0.517 | 0.61 | 0.85 |
| 387893 | NM_020382 | SETD8 | −1.57 | −1.54 | 0.708 | 0.73 | 0.97 |
| 387893 | NM_020382 | SETD8 | −2.15 | −1.49 | 0.728 | 0.70 | 1.03 |
| 124925 | NM_178860 | SEZ6 | −2.75 | −2.58 | 0.507 | 0.63 | 0.80 |
| 10291 | NM_005877 | SF3A1 | −2.45 | −2.31 | 0.657 | 0.67 | 0.99 |
| 10946 | NM_006802 | SF3A3 | −3.21 | −2.27 | 0.551 | 0.67 | 0.82 |
| 23451 | NM_012433 | SF3B1 | −2.80 | −3.80 | 0.561 | 0.39 | 1.43 |
| 10992 | XM_290506 | SF3B2 | −2.97 | −3.05 | 0.572 | 0.50 | 1.15 |
| 23450 | NM_012426 | SF3B3 | −2.68 | −3.02 | 0.580 | 0.52 | 1.13 |
| 83443 | NM_031287 | SF3B5 | −2.85 | −2.42 | 0.481 | 0.56 | 0.85 |
| 6421 | NM_005066 | SFPQ | −3.20 | −2.15 | 0.554 | 0.69 | 0.80 |
| 6428 | NM_003017 | SFRS3 | −2.44 | −1.02 | 0.657 | 0.85 | 0.77 |
| 6433 | NM_152235 | SFRS8 | −2.02 | −0.27 | 0.716 | 0.95 | 0.75 |
| 118980 | NM_178858 | SFXN2 | −2.36 | −2.38 | 0.577 | 0.67 | 0.86 |
| 151648 | NM_138484 | SGOL1 | −2.79 | −3.45 | 0.567 | 0.46 | 1.24 |
| 10044 | NM_005489 | SH2D3C | −3.26 | −3.20 | 0.579 | 0.52 | 1.10 |
| 79628 | NM_024577 | SH3TC2 | −1.87 | −1.78 | 0.673 | 0.73 | 0.93 |
| 25942 | NM_015477 | SIN3A | −2.22 | −1.74 | 0.679 | 0.75 | 0.91 |
| 140885 | NM_080792 | SIRPA | −1.58 | −0.36 | 0.737 | 0.94 | 0.79 |
| 284759 | XM_209363 | SIRPB2 | −2.09 | −2.32 | 0.620 | 0.67 | 0.93 |
| 51804 | NM_017420 | SIX4 | −2.08 | −1.56 | 0.746 | 0.70 | 1.07 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/HMLER Ratio |
|---|---|---|---|---|---|---|---|
| 147912 | NM_175875 | SIX5 | −1.60 | −1.10 | 0.716 | 0.84 | 0.85 |
| 4990 | NM_007374 | SIX6 | −2.27 | −1.42 | 0.722 | 0.72 | 1.00 |
| 7884 | NM_006527 | SLBP | −3.33 | −2.00 | 0.536 | 0.71 | 0.75 |
| 10723 | NM_006598 | SLC12A7 | −3.67 | −2.99 | 0.473 | 0.51 | 0.93 |
| 117247 | NM_018593 | SLC16A10 | −1.99 | −3.01 | 0.642 | 0.58 | 1.11 |
| 123041 | NM_153646 | SLC24A4 | −2.17 | −2.11 | 0.615 | 0.71 | 0.87 |
| 10166 | NM_014252 | SLC25A15 | −1.52 | −2.07 | 0.719 | 0.63 | 1.14 |
| 115286 | NM_173471 | SLC25A26 | −2.52 | −2.99 | 0.522 | 0.57 | 0.91 |
| 64924 | NM_022902 | SLC30A5 | −1.56 | −1.73 | 0.739 | 0.72 | 1.02 |
| 10463 | NM_006345 | SLC30A9 | −1.93 | −2.12 | 0.536 | 0.65 | 0.82 |
| 285641 | NM_181774 | SLC36A3 | −1.92 | −1.43 | 0.653 | 0.79 | 0.82 |
| 29986 | NM_014579 | SLC39A2 | −1.68 | −1.73 | 0.710 | 0.73 | 0.97 |
| 283375 | NM_173596 | SLC39A5 | −2.26 | −1.71 | 0.506 | 0.65 | 0.78 |
| 23446 | NM_022109 | SLC44A1 | −2.56 | −2.65 | 0.599 | 0.58 | 1.04 |
| 85414 | NM_033102 | SLC45A3 | −1.99 | −2.12 | 0.674 | 0.61 | 1.10 |
| 11309 | NM_007256 | SLCO2B1 | −1.99 | −1.67 | 0.714 | 0.73 | 0.98 |
| 6603 | NM_003077 | SMARCD2 | −2.09 | −0.28 | 0.740 | 0.94 | 0.79 |
| 23049 | NM_014006 | SMG1 | −1.75 | −2.13 | 0.685 | 0.70 | 0.98 |
| 6606 | NM_000344 | SMN1 | −2.54 | −1.74 | 0.662 | 0.66 | 1.01 |
| 6607 | NM_017411 | SMN2 | −1.65 | −1.57 | 0.732 | 0.73 | 1.01 |
| 55234 | NM_018225 | SMU1 | −3.35 | −3.96 | 0.208 | 0.40 | 0.52 |
| 80725 | NM_025248 | SNIP | −1.64 | −1.09 | 0.699 | 0.81 | 0.87 |
| 51429 | NM_016224 | SNX9 | −2.56 | −1.33 | 0.646 | 0.78 | 0.83 |
| 8435 | NM_003578 | SOAT2 | −2.47 | −2.23 | 0.688 | 0.56 | 1.23 |
| 6651 | NM_003103 | SON | −5.33 | −3.44 | 0.253 | 0.51 | 0.50 |
| 10615 | NM_006461 | SPAG5 | −1.81 | −1.73 | 0.572 | 0.72 | 0.80 |
| 83893 | NM_031955 | SPATA16 | −1.96 | −1.47 | 0.627 | 0.76 | 0.82 |
| 219938 | NM_174927 | SPATA19 | −1.85 | −1.75 | 0.708 | 0.70 | 1.01 |
| 84651 | NM_032566 | SPINK7 | −1.65 | −1.58 | 0.729 | 0.71 | 1.02 |
| 81848 | NM_030964 | SPRY4 | −1.68 | −1.63 | 0.690 | 0.70 | 0.99 |
| 136853 | NM_080744 | SRCRB4D | −2.36 | −2.26 | 0.695 | 0.66 | 1.05 |
| 253017 | XM_171068 | SRD5A2L2 | −2.28 | −1.31 | 0.639 | 0.78 | 0.82 |
| 6756 | NM_005635 | SSX1 | −2.26 | −0.88 | 0.723 | 0.83 | 0.87 |
| 57559 | NM_020799 | STAMBPL1 | −1.78 | −0.89 | 0.670 | 0.84 | 0.80 |
| 134429 | NM_139164 | STARD4 | −2.01 | −1.44 | 0.597 | 0.78 | 0.77 |
| 80765 | NM_030574 | STARD5 | −1.69 | −1.50 | 0.686 | 0.74 | 0.93 |
| 10273 | NM_005861 | STUB1 | −2.00 | −0.64 | 0.699 | 0.90 | 0.78 |
| 6804 | NM_004603 | STX1A | −2.18 | −0.72 | 0.732 | 0.88 | 0.83 |
| 56670 | NM_033050 | SUCNR1 | −1.51 | −1.94 | 0.724 | 0.70 | 1.03 |
| 6829 | NM_003169 | SUPT5H | −2.87 | −2.40 | 0.527 | 0.58 | 0.90 |
| 6830 | NM_003170 | SUPT6H | −2.94 | −2.08 | 0.619 | 0.69 | 0.90 |
| 9412 | NM_004264 | SURB7 | −2.22 | −2.07 | 0.714 | 0.69 | 1.03 |
| 136306 | NM_174959 | SVOPL | −2.43 | −2.66 | 0.522 | 0.58 | 0.89 |
| 25949 | NM_015484 | SYF2 | −2.96 | −3.00 | 0.535 | 0.52 | 1.04 |
| 54843 | NM_032379 | SYTL2 | −2.23 | −1.98 | 0.634 | 0.73 | 0.87 |
| 10460 | NM_006342 | TACC3 | −2.06 | −0.78 | 0.663 | 0.86 | 0.77 |
| 11138 | NM_007063 | TBC1D8 | −2.10 | −1.87 | 0.698 | 0.69 | 1.01 |
| 90665 | NM_033284 | TBL1Y | −2.12 | −2.38 | 0.571 | 0.65 | 0.87 |
| 6911 | NM_004608 | TBX6 | −2.44 | −1.22 | 0.697 | 0.77 | 0.91 |
| 8557 | NM_003673 | TCAP | −3.41 | −1.87 | 0.591 | 0.69 | 0.85 |
| 200132 | NM_152665 | TCTEX1D1 | −1.88 | −1.83 | 0.673 | 0.72 | 0.94 |
| 7011 | NM_007110 | TEP1 | −1.83 | −1.75 | 0.749 | 0.72 | 1.03 |
| 10227 | NM_001120 | TETRAN | −1.55 | −1.25 | 0.626 | 0.80 | 0.78 |
| 56159 | NM_031276 | TEX11 | −1.72 | −1.31 | 0.721 | 0.80 | 0.91 |
| 7018 | NM_001063 | TP | −1.90 | −2.37 | 0.730 | 0.66 | 1.11 |
| 7069 | NM_003251 | THRSP | −1.60 | −0.53 | 0.744 | 0.92 | 0.81 |
| 10333 | NM_006068 | TLR6 | −1.68 | −1.28 | 0.653 | 0.82 | 0.80 |
| 117532 | NM_080751 | TMC2 | −1.55 | −1.34 | 0.714 | 0.81 | 0.88 |
| 23671 | NM_016192 | TMEFF2 | −1.70 | −1.50 | 0.733 | 0.76 | 0.97 |
| 200728 | NM_198276 | TMEM17 | −2.02 | −1.07 | 0.646 | 0.82 | 0.79 |
| 80775 | NM_030577 | TMEM177 | −2.49 | −1.63 | 0.542 | 0.72 | 0.75 |
| 199964 | NM_182532 | TMEM61 | −1.97 | −1.35 | 0.660 | 0.78 | 0.84 |
| 137835 | NM_144649 | TMEM71 | −1.80 | −1.16 | 0.650 | 0.83 | 0.78 |
| 388730 | NM_203376 | TMEM81 | −1.91 | −1.25 | 0.565 | 0.74 | 0.76 |
| 388364 | NM_206832 | TMIGD1 | −2.12 | −2.28 | 0.610 | 0.60 | 1.01 |
| 28983 | NM_014058 | TMPRSS11E | −1.87 | −0.86 | 0.659 | 0.84 | 0.78 |
| 23495 | NM_012452 | TNFRSF13B | −2.22 | −1.33 | 0.688 | 0.78 | 0.88 |
| 8711 | NM_003985 | TNK1 | −1.64 | −1.81 | 0.682 | 0.74 | 0.92 |
| 85456 | NM_033396 | TNKS1BP1 | −2.17 | −1.33 | 0.643 | 0.75 | 0.86 |
| 7134 | NM_003280 | TNNC1 | −2.35 | −1.45 | 0.688 | 0.72 | 0.96 |
| 30000 | NM_013433 | TNPO2 | −3.20 | −3.50 | 0.489 | 0.46 | 1.06 |
| 26058 | NM_015575 | TNRC15 | −1.63 | −1.57 | 0.744 | 0.76 | 0.98 |
| 57690 | NM_018996 | TNRC6C | −2.03 | −1.25 | 0.656 | 0.78 | 0.84 |
| 7153 | NM_001067 | TOP2A | −2.28 | −3.06 | 0.635 | 0.53 | 1.20 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 7163 | NM_005079 | TPD52 | −2.30 | −1.61 | 0.629 | 0.75 | 0.84 |
| 93492 | NM_130785 | TPTE2 | −1.68 | −1.09 | 0.741 | 0.82 | 0.90 |
| 22974 | NM_012112 | TPX2 | −5.55 | −3.99 | 0.202 | 0.34 | 0.59 |
| 11139 | NM_007064 | TRAD | −1.84 | −1.79 | 0.632 | 0.74 | 0.85 |
| 7185 | NM_005658 | TRAF1 | −1.80 | −1.64 | 0.713 | 0.75 | 0.95 |
| 84231 | NM_032271 | TRAF7 | −1.97 | −1.44 | 0.624 | 0.76 | 0.82 |
| 58485 | NM_021210 | TRAPPC1 | −1.60 | −1.48 | 0.734 | 0.75 | 0.98 |
| 54209 | NM_018965 | TREM2 | −2.49 | −3.33 | 0.653 | 0.46 | 1.43 |
| 80128 | NM_025058 | TRIM46 | −1.58 | −1.15 | 0.709 | 0.79 | 0.89 |
| 84676 | NM_032588 | TRIM63 | −1.87 | −1.65 | 0.693 | 0.70 | 0.99 |
| 81786 | NM_033342 | TRIM7 | −1.64 | −1.82 | 0.696 | 0.67 | 1.04 |
| 54802 | NM_017646 | TRIT1 | −1.75 | −0.52 | 0.714 | 0.93 | 0.77 |
| 54822 | NM_017672 | TRPM7 | −1.63 | −0.38 | 0.711 | 0.94 | 0.75 |
| 29122 | NM_013270 | TSP50 | −1.94 | −1.42 | 0.658 | 0.78 | 0.84 |
| 26262 | NM_130465 | TSPAN17 | −2.78 | −2.50 | 0.558 | 0.62 | 0.90 |
| 84630 | XM_166453 | TTBK1 | −1.86 | −1.66 | 0.669 | 0.76 | 0.87 |
| 54902 | NM_017775 | TTC19 | −1.85 | −1.20 | 0.746 | 0.81 | 0.92 |
| 83538 | NM_031421 | TTC25 | −1.65 | −1.82 | 0.690 | 0.70 | 0.98 |
| 7272 | NM_003318 | TTK | −1.78 | −2.34 | 0.670 | 0.67 | 1.00 |
| 26140 | NM_015644 | TTLL3 | −2.13 | −2.96 | 0.663 | 0.52 | 1.27 |
| 57348 | NM_020659 | TTYH1 | −1.58 | −1.89 | 0.742 | 0.71 | 1.05 |
| 10376 | NM_006082 | TUBA1B | −2.55 | −1.42 | 0.650 | 0.78 | 0.84 |
| 84790 | NM_032704 | TUBA1C | −2.60 | −1.83 | 0.575 | 0.67 | 0.86 |
| 7283 | NM_001070 | TUBG1 | −2.08 | −0.55 | 0.714 | 0.91 | 0.78 |
| 11338 | NM_007279 | U2AF2 | −2.96 | −1.88 | 0.576 | 0.69 | 0.83 |
| 7311 | NM_003333 | UBA52 | −2.72 | −2.01 | 0.675 | 0.67 | 1.01 |
| 51271 | NM_016525 | UBAP1 | −1.66 | −0.46 | 0.733 | 0.93 | 0.79 |
| 9040 | NM_003969 | UBE2M | −1.80 | −1.42 | 0.709 | 0.78 | 0.91 |
| 54658 | NM_000463 | UGT1A1 | −1.63 | −1.77 | 0.739 | 0.72 | 1.02 |
| 54579 | NM_019078 | UGT1A5 | −1.59 | −1.19 | 0.716 | 0.84 | 0.86 |
| 51720 | NM_016290 | UIMC1 | −1.98 | −1.19 | 0.725 | 0.80 | 0.90 |
| 90249 | XM_030300 | UNC5A | −2.03 | −2.14 | 0.590 | 0.68 | 0.86 |
| 23353 | NM_025154 | UNC84A | −2.07 | −1.88 | 0.676 | 0.70 | 0.97 |
| 85451 | XM_036115 | UNK | −1.55 | −0.56 | 0.745 | 0.89 | 0.83 |
| 388325 | NM_207103 | UNQ5783 | −1.95 | −1.26 | 0.636 | 0.78 | 0.82 |
| 139596 | NM_145052 | UPRT | −1.56 | −1.92 | 0.696 | 0.71 | 0.98 |
| 27089 | NM_014402 | UQCRQ | −2.12 | −2.02 | 0.624 | 0.69 | 0.91 |
| 9097 | NM_005151 | USP14 | −1.83 | −0.67 | 0.719 | 0.89 | 0.80 |
| 373856 | XM_036729 | USP41 | −1.58 | −2.22 | 0.710 | 0.60 | 1.18 |
| 9712 | NM_014688 | USP6NL | −1.99 | −3.76 | 0.557 | 0.31 | 1.79 |
| 10208 | NM_005800 | USPL1 | −2.20 | −1.42 | 0.672 | 0.77 | 0.88 |
| 9686 | NM_014667 | VGLL4 | −1.69 | −2.30 | 0.617 | 0.57 | 1.08 |
| 7431 | NM_003380 | VIM | −2.39 | −1.95 | 0.713 | 0.68 | 1.05 |
| 8876 | NM_004666 | VNN1 | −1.67 | −0.42 | 0.732 | 0.94 | 0.78 |
| 155382 | XM_376631 | VPS37D | −1.84 | −0.95 | 0.717 | 0.84 | 0.85 |
| 11193 | NM_007187 | WBP4 | −1.91 | −0.83 | 0.724 | 0.86 | 0.84 |
| 23001 | NM_014991 | WDFY3 | −2.12 | −2.04 | 0.660 | 0.67 | 0.98 |
| 11169 | NM_007086 | WDHD1 | −2.17 | −2.19 | 0.691 | 0.64 | 1.08 |
| 91833 | NM_144574 | WDR20 | −1.59 | −1.08 | 0.696 | 0.85 | 0.82 |
| 79819 | NM_024763 | WDR78 | −2.50 | −2.83 | 0.564 | 0.56 | 1.00 |
| 7465 | NM_003390 | WEE1 | −3.71 | −5.41 | 0.316 | 0.23 | 1.37 |
| 164237 | NM_172005 | WFDC13 | −1.53 | −0.56 | 0.735 | 0.91 | 0.81 |
| 140686 | NM_181522 | WFDC3 | −1.56 | −1.00 | 0.684 | 0.83 | 0.82 |
| 90199 | NM_130896 | WFDC8 | −2.52 | −2.56 | 0.494 | 0.62 | 0.79 |
| 147179 | NM_133264 | WIPF2 | −2.23 | −2.43 | 0.604 | 0.64 | 0.94 |
| 7478 | NM_031933 | WNT8A | −2.09 | −2.53 | 0.708 | 0.59 | 1.20 |
| 56949 | NM_020196 | XAB2 | −4.01 | −3.62 | 0.349 | 0.44 | 0.80 |
| 170626 | NM_130776 | XAGE3 | −2.48 | −2.76 | 0.570 | 0.56 | 1.01 |
| 7512 | NM_003399 | XPNPEP2 | −2.25 | −1.68 | 0.692 | 0.74 | 0.94 |
| 2547 | NM_001469 | XRCC6 | −2.21 | −1.88 | 0.697 | 0.71 | 0.99 |
| 26137 | NM_015642 | ZBTB20 | −2.12 | −1.74 | 0.665 | 0.72 | 0.92 |
| 360023 | NM_194314 | ZBTB41 | −1.55 | −1.79 | 0.719 | 0.71 | 1.02 |
| 84186 | NM_032226 | ZCCHC7 | −1.91 | −1.27 | 0.640 | 0.79 | 0.81 |
| 55146 | NM_018106 | ZDHHC4 | −1.61 | −1.49 | 0.630 | 0.77 | 0.82 |
| 60685 | NM_021943 | ZFAND3 | −1.81 | −0.95 | 0.695 | 0.84 | 0.83 |
| 153527 | NM_144723 | ZMAT2 | −1.79 | −0.40 | 0.724 | 0.94 | 0.77 |
| 118490 | NM_178451 | ZMYND17 | −1.55 | −0.50 | 0.717 | 0.93 | 0.77 |
| 10778 | NM_006629 | ZNF271 | −1.79 | −1.50 | 0.744 | 0.75 | 0.99 |
| 92822 | NM_152287 | ZNF276 | −2.13 | −2.77 | 0.598 | 0.60 | 1.00 |
| 91975 | NM_052860 | ZNF300 | −1.81 | −2.22 | 0.650 | 0.68 | 0.95 |
| 57343 | NM_020657 | ZNF304 | −2.46 | −2.14 | 0.600 | 0.67 | 0.90 |
| 162967 | XM_371190 | ZNF320 | −1.81 | −1.18 | 0.684 | 0.81 | 0.85 |
| 79893 | NM_024835 | ZNF403 | −1.66 | −2.55 | 0.713 | 0.61 | 1.18 |
| 126070 | NM_152357 | ZNF440 | −1.64 | −2.02 | 0.704 | 0.72 | 0.98 |

TABLE 1-continued

Genes that Decreased BPLER Viability

| Entrez Gene ID | Accession # | Gene Symbol | MAD BPLER | MAD HMLER | Fold BPLER | Fold HMLER | BPLER/ HMLER Ratio |
|---|---|---|---|---|---|---|---|
| 168544 | XM_095168 | ZNF467 | −1.61 | −2.10 | 0.722 | 0.67 | 1.08 |
| 197407 | NM_152652 | ZNF553 | −1.75 | −1.73 | 0.693 | 0.72 | 0.96 |
| 147837 | NM_145276 | ZNF563 | −1.55 | −0.93 | 0.724 | 0.86 | 0.84 |
| 201514 | NM_173548 | ZNF584 | −2.15 | −1.61 | 0.659 | 0.74 | 0.90 |
| 169270 | NM_173539 | ZNF596 | −1.51 | −0.60 | 0.737 | 0.89 | 0.82 |
| 80095 | NM_025027 | ZNF606 | −1.85 | −1.12 | 0.656 | 0.80 | 0.82 |
| 23352 | NM_020765 | ZUBR1 | −1.93 | −0.63 | 0.692 | 0.90 | 0.77 |

TABLE 2A

Highly Selective siRNAs (SEQ ID NOs: 1-4, 6, 7, 13, 14, 23, 29, 33-35, 37, 38, 66, 72, 77, 78, 84, 91, 93, and 151)

| Entrez Gene ID | Accession # | Gene Symbol | Catalog # | MAD BPLER | MAD HMLER | Fold BPLER | Fold_HMLER | BPLER_RSD | HMLER_RSD | Ratio | Cherry Score |
|---|---|---|---|---|---|---|---|---|---|---|---|
| 5692 | NM_002796 | PSMB4 | M-011362-00 | −6.73 | −2.41 | 0.147 | 0.52 | 0.07 | 0.13 | 0.28 | 4 |
| 5682 | NM_002786 | PSMA1 | M-010123-01 | −5.53 | −2.21 | 0.240 | 0.65 | 0.06 | 0.07 | 0.37 | 4 |
| 29127 | NM_013277 | RACGAP1 | M-008650-00 | −3.61 | −1.46 | 0.361 | 0.77 | 0.14 | 0.08 | 0.47 | 4 |
| 5702 | NM_002804 | PSMC3 | M-008738-01 | −1.77 | −1.02 | 0.399 | 0.81 | 0.10 | 0.07 | 0.49 | 4 |
| 1659 | NM_004941 | DHX8 | M-010506-01 | −4.27 | −1.24 | 0.413 | 0.81 | 0.05 | 0.05 | 0.51 | 4 |
| 5684 | NM_002788 | PSMA3 | M-011758-00 | −1.72 | −0.54 | 0.434 | 0.90 | 0.17 | 0.09 | 0.48 | 4 |
| 11269 | NM_007242 | DDX19B | M-013471-00 | −4.84 | −2.09 | 0.304 | 0.66 | 0.07 | 0.06 | 0.46 | 3 |
| 22938 | NM_012245 | SNW1 | M-012446-00 | −5.45 | −1.31 | 0.335 | 0.75 | 0.10 | 0.08 | 0.45 | 3 |
| 79441 | NM_024511 | C4orf15 | M-018131-00 | −2.52 | 0.55 | 0.560 | 1.09 | 0.09 | 0.03 | 0.52 | 3 |
| 5683 | NM_002787 | PSMA2 | M-011757-00 | −4.14 | −2.79 | 0.205 | 0.54 | 0.15 | 0.01 | 0.38 | 2 |
| 10594 | NM_006445 | PRPF8 | M-012252-01 | −5.34 | −2.64 | 0.246 | 0.62 | 0.22 | 0.04 | 0.40 | 2 |
| 5713 | NM_002811 | PSMD7 | M-009621-01 | −3.88 | −2.86 | 0.256 | 0.53 | 0.08 | 0.02 | 0.49 | 2 |
| 5901 | NM_006325 | RAN | M-010353-00 | −5.67 | −2.89 | 0.266 | 0.57 | 0.06 | 0.10 | 0.47 | 2 |
| 59286 | NM_024292 | UBL5 | M-014320-00 | −4.14 | −2.33 | 0.337 | 0.64 | 0.11 | 0.01 | 0.53 | 2 |
| 5515 | NM_002715 | PPP2CA | M-003598-00 | −2.77 | −0.87 | 0.457 | 0.86 | 0.07 | 0.09 | 0.53 | 2 |
| 5700 | NM_002802 | PSMC1 | M-009578-00 | −1.50 | −0.45 | 0.476 | 0.91 | 0.19 | 0.04 | 0.52 | 2 |
| 57474 | NM_020714 | ZNF490 | M-013937-00 | −4.40 | −2.66 | 0.285 | 0.59 | 0.08 | 0.03 | 0.49 | 1 |
| 147015 | NM_144683 | DHRS13 | M-008777-00 | −3.66 | −1.69 | 0.350 | 0.75 | 0.04 | 0.07 | 0.47 | 1 |
| 64763 | NM_022752 | ZNF574 | M-007054-00 | −3.52 | −1.41 | 0.425 | 0.79 | 0.15 | 0.11 | 0.54 | 1 |
| 91869 | NM_052859 | RFT1 | M-018174-00 | −2.82 | 0.04 | 0.468 | 1.01 | 0.12 | 0.05 | 0.47 | 1 |
| 65243 | NM_023070 | ZNF643 | M-007056-00 | −3.05 | −0.52 | 0.493 | 0.92 | 0.14 | 0.03 | 0.54 | 1 |
| 84922 | NM_032836 | FIZ1 | M-015014-00 | −2.97 | −0.32 | 0.514 | 0.94 | 0.07 | 0.05 | 0.55 | 1 |
| 23474 | NM_014297 | ETHE1 | M-012508-00 | −2.19 | 1.03 | 0.641 | 1.17 | 0.25 | 0.05 | 0.55 | 1 |
| 80863 | NM_030651 | PRRT1 | M-016655-00 | −3.57 | −2.00 | 0.348 | 0.64 | 0.18 | 0.10 | 0.54 | 0 |
| 2850 | NM_018971 | GPR27 | M-005562-01 | −3.35 | −1.23 | 0.385 | 0.81 | 0.05 | 0.15 | 0.47 | 0 |
| 9503 | NM_020411 | XAGE1 | M-013187-00 | −2.09 | 0.53 | 0.541 | 1.11 | 0.09 | 0.17 | 0.49 | 0 |

TABLE 2B

Moderately Selective siRNAs

| Entrez Gene ID | Accession # | Gene Symbol | Catalog # | MAD BPLER | MAD HMLER | Fold_BPLER |
|---|---|---|---|---|---|---|
| 84950 | NM_032864 | PRPF38A | M-014833-00 | −3.64 | −1.70 | 0.403 |
| 5431 | NM_000938 | POLR2B | M-011187-00 | −4.09 | −1.97 | 0.438 |
| 115106 | NM_138443 | CCDC5 | M-015491-00 | −2.18 | −0.02 | 0.583 |
| 11157 | NM_007080 | LSM6 | M-019754-00 | −2.83 | −0.41 | 0.593 |
| 5708 | NM_002808 | PSMD2 | M-017212-01 | −4.64 | −2.67 | 0.343 |
| 10213 | NM_005805 | PSMD14 | M-006024-00 | −3.37 | −2.28 | 0.352 |
| 10403 | NM_006101 | NDC80 | M-004106-00 | −3.24 | −2.06 | 0.377 |
| 79680 | NM_024627 | C22orf29 | M-016338-00 | −3.47 | −2.46 | 0.400 |
| 24148 | NM_012469 | PRPF6 | M-012821-00 | −3.13 | −1.23 | 0.508 |
| 57819 | NM_021177 | LSM2 | M-017813-00 | −2.90 | −0.95 | 0.512 |
| 9861 | NM_014814 | PSMD6 | M-021249-00 | −2.05 | −0.79 | 0.516 |
| 91746 | NM_133370 | YTHDC1 | M-015332-00 | −2.31 | −0.26 | 0.567 |
| 57461 | NM_020701 | ISY1 | M-013894-00 | −4.27 | −2.95 | 0.306 |
| 55696 | NM_018047 | RBM22 | M-021186-00 | −2.37 | −1.53 | 0.477 |
| 151903 | NM_144716 | CCDC12 | M-015455-00 | −3.22 | −1.34 | 0.502 |
| 83540 | NM_031423 | NUF2 | M-005289-01 | −2.68 | −0.90 | 0.515 |
| 26036 | NM_015555 | ZNF451 | M-013935-00 | −3.07 | −0.77 | 0.516 |
| 1213 | NM_004859 | CLTC | M-004001-00 | −2.02 | 0.05 | 0.570 |

TABLE 2B-continued

| | | Moderately Selective siRNAs | | | | |
|---|---|---|---|---|---|---|
| 2597 | NM_002046 | GAPDH | M-004253-01 | −4.30 | −0.19 | 0.576 |
| 5211 | NM_002626 | PFKL | M-006822-00 | −1.85 | −0.10 | 0.630 |
| 55735 | NM_018198 | DNAJC11 | M-021205-00 | −1.52 | 0.75 | 0.656 |
| 57835 | NM_021196 | SLC4A5 | M-007585-00 | −1.94 | 0.63 | 0.672 |
| 388531 | NM_207391 | RGS9BP | M-032069-00 | −1.58 | 0.53 | 0.707 |
| 154007 | NM_152551 | C6orf151 | M-018855-00 | −1.75 | 1.64 | 0.730 |
| 1315 | NM_016451 | COPB1 | M-017940-00 | −3.13 | −2.91 | 0.326 |
| 3190 | NM_002140 | HNRPK | M-011692-00 | −3.35 | −2.71 | 0.358 |
| 10114 | NM_005734 | HIPK3 | M-004810-00 | −3.97 | −2.34 | 0.418 |
| 11325 | NM_007372 | DDX42 | M-012393-00 | −4.00 | −1.78 | 0.425 |
| 90407 | NM_080652 | TMEM41A | M-015245-00 | −2.70 | −1.83 | 0.457 |
| 9821 | NM_014781 | RB1CC1 | M-021117-00 | −3.21 | −1.50 | 0.466 |
| 51477 | NM_016368 | ISYNA1 | M-009669-00 | −1.95 | −0.82 | 0.489 |
| 286826 | NM_173083 | LIN9 | M-018918-00 | −2.90 | −0.72 | 0.525 |
| 84975 | NM_032889 | MFSD5 | M-018634-00 | −2.81 | −0.38 | 0.540 |
| 79622 | NM_024571 | C16orf33 | M-014370-00 | −2.67 | −0.58 | 0.540 |
| 6457 | NM_003027 | SH3GL3 | M-015728-00 | −2.67 | −0.55 | 0.544 |
| 5128 | NM_002595 | PCTK2 | M-004835-01 | −2.29 | −0.79 | 0.552 |
| 29945 | NM_013367 | ANAPC4 | M-013642-00 | −2.96 | −0.79 | 0.557 |
| 64236 | NM_021630 | PDLIM2 | M-010731-00 | −2.65 | −0.34 | 0.563 |
| 27316 | NM_002139 | RBMX | M-011691-00 | −2.43 | −0.57 | 0.569 |
| 56931 | NM_020175 | DUS3L | M-031942-00 | −2.65 | −0.71 | 0.571 |
| 51473 | NM_016356 | DCDC2 | M-020868-00 | −1.61 | −0.02 | 0.571 |
| 55957 | NM_019104 | LIN37 | M-013311-00 | −1.92 | −0.19 | 0.571 |
| 4247 | NM_002408 | MGAT2 | M-011333-00 | −2.06 | −0.19 | 0.586 |
| 115361 | NM_052941 | GBP4 | M-018177-00 | −2.09 | −0.14 | 0.608 |
| 8291 | NM_003494 | DYSF | M-003652-01 | −2.13 | 0.64 | 0.614 |
| 57456 | NM_020696 | KIAA1143 | M-013876-00 | −2.27 | 0.86 | 0.631 |
| 255104 | NM_181719 | TMCO4 | M-018952-00 | −1.74 | −0.01 | 0.638 |
| 3763 | NM_002240 | KCNJ6 | M-006251-00 | −1.88 | 0.12 | 0.654 |
| 8621 | NM_003718 | CDC2L5 | M-004688-00 | −2.34 | 0.95 | 0.656 |
| 89777 | NM_080474 | SERPINB12 | M-008758-00 | −1.66 | 0.63 | 0.668 |
| 26994 | NM_014372 | RNF11 | M-006971-00 | −1.86 | 1.11 | 0.671 |
| 91978 | NM_033513 | C19orf20 | M-023892-00 | −1.69 | 0.87 | 0.684 |
| 192134 | NM_138706 | B3GNT6 | M-016388-00 | −1.80 | 0.45 | 0.691 |
| 154075 | NM_152552 | SAMD3 | M-015449-00 | −1.99 | 0.68 | 0.692 |
| 2838 | NM_005290 | GPR15 | M-005550-00 | −1.58 | 0.72 | 0.708 |
| 79443 | NM_024513 | FYCO1 | M-014350-00 | −1.67 | 0.86 | 0.714 |
| 150946 | XM_097977 | FAM59B | M-022647-00 | −1.85 | 0.68 | 0.714 |
| 59269 | NM_024503 | HIVEP3 | M-014345-00 | −5.23 | −2.35 | 0.306 |
| 554 | NM_000054 | AVPR2 | M-005432-00 | −3.26 | −2.16 | 0.401 |
| 57621 | NM_020861 | ZBTB2 | M-014129-00 | −3.50 | −1.59 | 0.412 |
| 57701 | XM_035497 | KIAA1602 | M-026953-00 | −3.29 | −1.54 | 0.446 |
| 148930 | NM_182516 | L5 | M-018573-00 | −2.89 | −1.47 | 0.486 |
| 285676 | NM_182594 | ZNF454 | M-018860-00 | −2.78 | −0.94 | 0.494 |
| 1633 | NM_000788 | DCK | M-006710-00 | −3.39 | −1.32 | 0.502 |
| 8335 | NM_003513 | HIST1H2AB | M-017596-00 | −1.78 | −1.23 | 0.504 |
| 84458 | XM_050988 | LCOR | M-026303-00 | −2.98 | −0.81 | 0.511 |
| 11281 | NM_007252 | POU6F2 | M-019645-00 | −3.27 | −0.75 | 0.529 |
| 8653 | NM_004660 | DDX3Y | M-011904-00 | −1.66 | −1.17 | 0.537 |
| 1175 | NM_004069 | AP2S1 | M-011833-00 | −1.99 | −0.34 | 0.562 |
| 83787 | NM_031905 | ARMC10 | M-018188-00 | −2.13 | 0.45 | 0.596 |
| 9085 | NM_004680 | CDY1 | M-008916-00 | −1.86 | −0.49 | 0.599 |
| 285888 | XM_376727 | CNPY1 | M-028750-00 | −2.15 | 0.40 | 0.612 |
| 117178 | NM_014021 | SSX2IP | M-020361-00 | −2.15 | −0.09 | 0.615 |
| 1769 | NM_001371 | DNAH8 | M-010075-00 | −1.78 | −0.24 | 0.621 |
| 149954 | NM_182519 | C20orf186 | M-009125-00 | −1.71 | 1.00 | 0.695 |
| 167838 | XM_371849 | TXLNB | M-024703-00 | −1.58 | 1.06 | 0.724 |

| Entrez Gene ID | Fold_HMLER | BPLER_RSD | HMLER_RSD | Ratio | Cherry Score |
|---|---|---|---|---|---|
| 84950 | 0.69 | 0.05 | 0.02 | 0.58 | 4 |
| 5431 | 0.69 | 0.04 | 0.01 | 0.63 | 4 |
| 115106 | 1.00 | 0.21 | 0.02 | 0.59 | 4 |
| 11157 | 0.93 | 0.02 | 0.08 | 0.64 | 4 |
| 5708 | 0.61 | 0.16 | 0.04 | 0.56 | 3 |
| 10213 | 0.62 | 0.06 | 0.10 | 0.56 | 3 |
| 10403 | 0.66 | 0.07 | 0.02 | 0.57 | 3 |
| 79680 | 0.62 | 0.05 | 0.02 | 0.64 | 3 |
| 24148 | 0.81 | 0.20 | 0.13 | 0.62 | 3 |
| 57819 | 0.84 | 0.09 | 0.05 | 0.61 | 3 |
| 9861 | 0.87 | 0.05 | 0.08 | 0.59 | 3 |
| 91746 | 0.96 | 0.19 | 0.06 | 0.59 | 3 |
| 57461 | 0.54 | 0.07 | 0.06 | 0.56 | 2 |
| 55696 | 0.78 | 0.08 | 0.03 | 0.61 | 2 |
| 151903 | 0.78 | 0.14 | 0.15 | 0.64 | 2 |
| 83540 | 0.84 | 0.06 | 0.05 | 0.62 | 2 |

TABLE 2B-continued

| Moderately Selective siRNAs | | | | | |
|---|---|---|---|---|---|
| 26036 | 0.86 | 0.19 | 0.17 | 0.60 | 2 |
| 1213 | 1.01 | 0.05 | 0.00 | 0.57 | 2 |
| 2597 | 0.97 | 0.11 | 0.09 | 0.60 | 2 |
| 5211 | 0.98 | 0.17 | 0.02 | 0.64 | 2 |
| 55735 | 1.11 | 0.16 | 0.03 | 0.59 | 2 |
| 57835 | 1.11 | 0.21 | 0.06 | 0.61 | 2 |
| 388531 | 1.10 | 0.07 | 0.06 | 0.64 | 2 |
| 154007 | 1.26 | 0.10 | 0.02 | 0.58 | 2 |
| 1315 | 0.54 | 0.24 | 0.09 | 0.61 | 1 |
| 3190 | 0.55 | 0.12 | 0.08 | 0.65 | 1 |
| 10114 | 0.68 | 0.07 | 0.02 | 0.61 | 1 |
| 11325 | 0.71 | 0.04 | 0.04 | 0.60 | 1 |
| 90407 | 0.73 | 0.08 | 0.04 | 0.63 | 1 |
| 9821 | 0.74 | 0.18 | 0.04 | 0.63 | 1 |
| 51477 | 0.87 | 0.18 | 0.07 | 0.57 | 1 |
| 286826 | 0.90 | 0.08 | 0.07 | 0.59 | 1 |
| 84975 | 0.93 | 0.10 | 0.05 | 0.58 | 1 |
| 79622 | 0.91 | 0.07 | 0.03 | 0.59 | 1 |
| 6457 | 0.90 | 0.15 | 0.03 | 0.60 | 1 |
| 5128 | 0.87 | 0.05 | 0.06 | 0.64 | 1 |
| 29945 | 0.87 | 0.06 | 0.04 | 0.64 | 1 |
| 64236 | 0.95 | 0.10 | 0.03 | 0.60 | 1 |
| 27316 | 0.91 | 0.16 | 0.03 | 0.62 | 1 |
| 56931 | 0.89 | 0.08 | 0.02 | 0.64 | 1 |
| 51473 | 1.00 | 0.19 | 0.19 | 0.57 | 1 |
| 55957 | 0.97 | 0.21 | 0.02 | 0.59 | 1 |
| 4247 | 0.97 | 0.02 | 0.07 | 0.60 | 1 |
| 115361 | 0.99 | 0.15 | 0.15 | 0.62 | 1 |
| 8291 | 1.12 | 0.11 | 0.08 | 0.55 | 1 |
| 57456 | 1.14 | 0.14 | 0.06 | 0.56 | 1 |
| 255104 | 0.99 | 0.13 | 0.04 | 0.64 | 1 |
| 3763 | 1.04 | 0.16 | 0.14 | 0.63 | 1 |
| 8621 | 1.13 | 0.03 | 0.08 | 0.58 | 1 |
| 89777 | 1.09 | 0.07 | 0.04 | 0.61 | 1 |
| 26994 | 1.17 | 0.01 | 0.07 | 0.57 | 1 |
| 91978 | 1.13 | 0.09 | 0.04 | 0.61 | 1 |
| 192134 | 1.07 | 0.17 | 0.07 | 0.65 | 1 |
| 154075 | 1.11 | 0.09 | 0.06 | 0.62 | 1 |
| 2838 | 1.11 | 0.09 | 0.03 | 0.64 | 1 |
| 79443 | 1.13 | 0.05 | 0.01 | 0.63 | 1 |
| 150946 | 1.10 | 0.20 | 0.07 | 0.65 | 1 |
| 59269 | 0.54 | 0.10 | 0.05 | 0.57 | 0 |
| 554 | 0.66 | 0.10 | 0.14 | 0.60 | 0 |
| 57621 | 0.73 | 0.09 | 0.02 | 0.56 | 0 |
| 57701 | 0.74 | 0.11 | 0.04 | 0.60 | 0 |
| 148930 | 0.78 | 0.04 | 0.08 | 0.62 | 0 |
| 285676 | 0.87 | 0.03 | 0.21 | 0.57 | 0 |
| 1633 | 0.82 | 0.05 | 0.01 | 0.61 | 0 |
| 8335 | 0.83 | 0.07 | 0.01 | 0.61 | 0 |
| 84458 | 0.85 | 0.10 | 0.03 | 0.60 | 0 |
| 11281 | 0.88 | 0.16 | 0.08 | 0.60 | 0 |
| 8653 | 0.83 | 0.08 | 0.05 | 0.64 | 0 |
| 1175 | 0.94 | 0.19 | 0.09 | 0.60 | 0 |
| 83787 | 1.07 | 0.12 | 0.06 | 0.56 | 0 |
| 9085 | 0.93 | 0.04 | 0.12 | 0.64 | 0 |
| 285888 | 1.06 | 0.05 | 0.08 | 0.58 | 0 |
| 117178 | 0.98 | 0.01 | 0.04 | 0.63 | 0 |
| 1769 | 0.96 | 0.14 | 0.01 | 0.65 | 0 |
| 149954 | 1.15 | 0.11 | 0.02 | 0.61 | 0 |
| 167838 | 1.16 | 0.14 | 0.13 | 0.62 | 0 |

TABLE 2C

Modestly Selective siRNAs

| Accession # | Catalog # | Gene Symbol | MAD_BPLER | MAD_HMLER | Fold_BPLER |
|---|---|---|---|---|---|
| NM_002696 | M-011357-00 | POLR2G | −3.59 | −1.68 | 0.507 |
| NM_018097 | M-021161-00 | CEP27 | −1.99 | −1.76 | 0.522 |
| XM_058073 | M-010646-00 | NUP205 | −2.88 | −1.57 | 0.544 |
| XM_375557 | M-031204-00 | C19orf29 | −2.24 | −0.36 | 0.625 |
| NM_001253 | M-011237-00 | CDC5L | −1.60 | −0.87 | 0.654 |
| NM_006292 | M-003549-01 | TSG101 | −2.45 | 0.23 | 0.684 |
| NM_016937 | M-020856-00 | POLA1 | −2.01 | −0.17 | 0.724 |

TABLE 2C-continued

| | | Modestly Selective siRNAs | | | |
|---|---|---|---|---|---|
| NM_032916 | M-015046-00 | FAM86B1 | −2.54 | −2.05 | 0.491 |
| NM_001237 | M-003205-02 | CCNA2 | −2.79 | −1.39 | 0.499 |
| NM_016047 | M-020260-00 | SF3B14 | −2.97 | −2.06 | 0.500 |
| NM_007364 | M-008051-00 | TMED3 | −2.93 | −1.28 | 0.537 |
| NM_014347 | M-006964-00 | ZNF324 | −2.91 | −1.05 | 0.543 |
| NM_007263 | M-017632-00 | COPE | −3.15 | −1.43 | 0.547 |
| NM_005063 | M-005061-01 | SCD | −3.24 | −1.58 | 0.555 |
| NM_032425 | M-022058-00 | KIAA1822 | −2.67 | −1.27 | 0.563 |
| NM_020860 | M-013166-00 | STIM2 | −2.39 | −0.99 | 0.597 |
| NM_018242 | M-013347-00 | SLC47A1 | −1.62 | −0.71 | 0.613 |
| NM_004336 | M-004102-00 | BUB1 | −2.62 | −0.62 | 0.617 |
| NM_152655 | M-016432-00 | ZNF585A | −2.06 | −0.70 | 0.642 |
| NM_182640 | M-019184-00 | MRPS9 | −2.00 | −0.45 | 0.669 |
| NM_022830 | M-014221-00 | TUT1 | −1.91 | −0.07 | 0.680 |
| XM_370928 | M-022880-00 | TBC1D24 | −1.97 | −0.32 | 0.680 |
| NM_152374 | M-016893-00 | FLJ38984 | −1.50 | −0.23 | 0.693 |
| NM_006590 | M-006087-00 | USP39 | −2.13 | −0.04 | 0.695 |
| NM_016200 | M-017030-00 | LSM8 | −1.76 | −0.26 | 0.700 |
| NM_003981 | M-019491-00 | PRC1 | −3.08 | −2.40 | 0.409 |
| NM_020882 | M-024094-00 | COL20A1 | −3.47 | −2.58 | 0.416 |
| NM_021974 | M-004723-00 | POLR2F | −3.46 | −2.98 | 0.417 |
| NM_018271 | M-020368-00 | FLJ10916 | −2.39 | −2.48 | 0.440 |
| XM_378175 | M-003993-01 | LOC124446 | −3.04 | −2.49 | 0.458 |
| NM_014456 | M-004438-02 | PDCD4 | −2.81 | −2.25 | 0.462 |
| NM_152496 | M-016951-00 | MANEAL | −3.02 | −2.41 | 0.464 |
| NM_174931 | M-017855-00 | CCDC75 | −3.33 | −2.06 | 0.474 |
| XM_371354 | M-022129-00 | KIF26B | −1.95 | −1.15 | 0.536 |
| NM_004739 | M-008482-00 | MTA2 | −3.71 | −1.07 | 0.545 |
| NM_198080 | M-021432-00 | MSRB3 | −2.72 | −0.86 | 0.571 |
| NM_000792 | M-011170-00 | DIO1 | −1.96 | −1.39 | 0.573 |
| NM_013366 | M-003200-02 | ANAPC2 | −2.80 | −1.31 | 0.580 |
| NM_001746 | M-003636-02 | CANX | −1.92 | −1.38 | 0.587 |
| NM_148571 | M-013182-00 | MRPL27 | −1.57 | −1.17 | 0.587 |
| NM_002255 | M-018983-00 | KIR2DL4 | −2.02 | −0.98 | 0.593 |
| NM_024762 | M-014438-00 | ZNF552 | −2.35 | −1.30 | 0.595 |
| NM_052946 | M-015170-00 | NOSTRIN | −2.06 | −0.69 | 0.604 |
| NM_002636 | M-011353-00 | PHF1 | −3.21 | −0.72 | 0.606 |
| NM_015046 | M-021420-00 | SETX | −2.40 | −0.72 | 0.617 |
| NM_006204 | M-007653-00 | PDE6C | −1.98 | −0.33 | 0.621 |
| NM_001225 | M-004404-00 | CASP4 | −2.36 | −0.92 | 0.623 |
| NM_000172 | M-009827-01 | GNAT1 | −2.03 | −0.36 | 0.627 |
| NM_002270 | M-011308-00 | TNPO1 | −1.99 | −0.59 | 0.630 |
| NM_030969 | M-015288-00 | TMEM14B | −1.99 | −0.56 | 0.636 |
| NM_020689 | M-007466-00 | SLC24A3 | −2.23 | −0.75 | 0.637 |
| NM_020395 | M-015624-00 | INTS12 | −2.22 | −0.74 | 0.639 |
| NM_021640 | M-013747-00 | C12orf10 | −2.11 | −0.54 | 0.644 |
| NM_014750 | M-016846-00 | DLG7 | −1.93 | −0.56 | 0.646 |
| NM_194324 | M-019295-00 | MGC39900 | −2.13 | −0.87 | 0.647 |
| NM_014420 | M-020520-00 | DKK4 | −1.90 | −0.72 | 0.657 |
| NM_012202 | M-012804-00 | GNG3 | −1.86 | −0.62 | 0.658 |
| NM_001797 | M-013493-00 | CDH11 | −1.56 | −0.69 | 0.663 |
| NM_002513 | M-006753-00 | NME3 | −1.71 | 0.12 | 0.668 |
| NM_005954 | M-012728-00 | MT3 | −1.77 | −0.16 | 0.672 |
| NM_000322 | M-011102-00 | PRPH2 | −1.69 | −0.56 | 0.675 |
| NM_021960 | M-004501-04 | MCL1 | −1.74 | −0.13 | 0.679 |
| NM_000131 | M-005871-00 | F7 | −2.01 | −0.06 | 0.679 |
| NM_020380 | M-015673-00 | CASC5 | −1.86 | −0.56 | 0.686 |
| NM_022304 | M-005630-01 | HRH2 | −1.68 | −0.39 | 0.693 |
| NM_005003 | M-019897-00 | NDUFAB1 | −1.82 | −0.20 | 0.694 |
| NM_032024 | M-014765-00 | C10orf11 | −1.58 | −0.06 | 0.702 |
| NM_134444 | M-015351-00 | NLRP4 | −1.68 | 0.11 | 0.702 |
| XM_371074 | M-030921-00 | TANC2 | −1.86 | 0.40 | 0.709 |
| NM_080730 | M-012988-00 | HOM-TES-103 | −1.84 | −0.09 | 0.711 |
| NM_005713 | M-012101-00 | COL4A3BP | −1.96 | 0.03 | 0.715 |
| NM_152905 | M-008306-00 | NEDD1 | −1.56 | 0.59 | 0.721 |
| NM_020528 | M-013199-00 | PCBP3 | −1.69 | 0.15 | 0.727 |
| NM_006156 | M-020081-00 | NEDD8 | −1.79 | 0.25 | 0.736 |
| NM_012141 | M-012417-00 | INTS6 | −3.48 | −2.65 | 0.369 |
| NM_173626 | M-007490-00 | SLC26A11 | −3.21 | −2.50 | 0.415 |
| NM_003301 | M-005747-00 | TRHR | −3.02 | −2.31 | 0.423 |
| NM_020809 | M-026514-00 | ARHGAP20 | −3.36 | −2.17 | 0.434 |
| NM_004277 | M-007483-00 | SLC25A27 | −2.81 | −1.80 | 0.476 |
| NM_016082 | M-013297-01 | CDK5RAP1 | −3.57 | −2.01 | 0.477 |
| NM_030962 | M-014684-00 | SBF2 | −2.84 | −1.47 | 0.481 |
| NM_001538 | M-011295-00 | HSF4 | −4.01 | −1.43 | 0.512 |
| NM_173556 | M-018459-00 | CCDC83 | −3.06 | −1.36 | 0.518 |
| XM_016548 | M-025053-00 | CDY2B | −3.04 | −1.73 | 0.521 |

TABLE 2C-continued

Modestly Selective siRNAs

| | | | | | |
|---|---|---|---|---|---|
| XM_056282 | M-024572-00 | LRRC62 | -2.35 | -1.74 | 0.528 |
| NM_182703 | M-019312-00 | ANKDD1A | -2.87 | -1.76 | 0.532 |
| NM_005831 | M-010637-00 | CALCOCO2 | -2.43 | -1.58 | 0.533 |
| NM_003526 | M-011446-00 | HIST1H2BC | -1.64 | -1.61 | 0.541 |
| NM_005911 | M-008818-00 | MAT2A | -2.25 | -1.21 | 0.547 |
| NM_022567 | M-014165-00 | NYX | -2.34 | -0.97 | 0.550 |
| NM_018360 | M-020815-00 | CXorf15 | -2.01 | -1.59 | 0.555 |
| NM_182558 | M-018912-00 | C12orf36 | -1.99 | -0.99 | 0.556 |
| NM_016388 | M-020821-00 | TRAT1 | -2.24 | -1.24 | 0.557 |
| NM_006413 | M-015336-00 | RPP30 | -1.84 | -1.38 | 0.558 |
| NM_024619 | M-006817-00 | FN3KRP | -2.98 | -1.53 | 0.562 |
| NM_001937 | M-011641-00 | DPT | -2.02 | -1.01 | 0.565 |
| XM_375187 | M-022211-00 | NUT | -1.98 | -0.97 | 0.574 |
| NM_178168 | M-008750-00 | OR10A5 | -2.31 | -1.21 | 0.576 |
| NM_020320 | M-013767-00 | RARS2 | -2.61 | -1.37 | 0.576 |
| NM_003685 | M-009490-00 | KHSRP | -1.93 | -1.15 | 0.582 |
| NM_152603 | M-016451-00 | ZNF567 | -2.39 | -1.09 | 0.585 |
| XM_114430 | M-024410-00 | LOC202051 | -2.59 | -0.79 | 0.592 |
| NM_198494 | M-027243-00 | ZNF642 | -2.47 | -0.63 | 0.594 |
| NM_152465 | M-016422-00 | PROCA1 | -2.24 | -1.20 | 0.602 |
| NM_152647 | M-016412-00 | C15orf33 | -2.27 | -0.50 | 0.604 |
| NM_138451 | M-015615-00 | IQCD | -2.04 | -1.20 | 0.605 |
| NM_024011 | M-004026-01 | CDC2L2 | -2.70 | -0.55 | 0.605 |
| NM_024647 | M-018906-00 | NUP43 | -2.40 | -1.30 | 0.605 |
| NM_152515 | M-018844-00 | CKAP2L | -2.56 | -1.17 | 0.605 |
| NM_207401 | M-032078-00 | FLJ45717 | -1.68 | -0.82 | 0.611 |
| NM_144702 | M-015707-00 | C1orf92 | -2.17 | -0.90 | 0.615 |
| XM_371575 | M-027984-00 | PRPF40A | -1.75 | -0.96 | 0.623 |
| XM_209941 | M-026255-00 | C9orf117 | -2.01 | -0.84 | 0.635 |
| NM_015446 | M-013961-00 | AHCTF1 | -2.29 | -0.69 | 0.635 |
| NM_019067 | M-015743-00 | GNL3L | -2.24 | -0.43 | 0.636 |
| NM_018922 | M-013292-00 | PCDHGB1 | -1.67 | -0.81 | 0.637 |
| NM_032866 | M-019002-00 | CGNL1 | -2.22 | -0.57 | 0.637 |
| NM_213604 | M-023895-00 | ADAMTSL5 | -2.21 | -0.83 | 0.640 |
| NM_018129 | M-009715-00 | PNPO | -1.55 | -0.72 | 0.641 |
| NM_002510 | M-011741-00 | GPNMB | -1.52 | -0.76 | 0.641 |
| NM_004783 | M-004171-03 | TAOK2 | -1.82 | -0.32 | 0.648 |
| XM_089747 | M-026312-00 | C10orf80 | -2.25 | -0.73 | 0.653 |
| NM_173821 | M-018155-00 | FLJ33590 | -1.90 | -0.56 | 0.656 |
| NM_014891 | M-017675-00 | PDAP1 | -1.78 | -0.08 | 0.658 |
| NM_005301 | M-005567-00 | GPR35 | -1.85 | -0.49 | 0.661 |
| NM_021049 | M-010800-00 | MAGEA5 | -1.68 | -0.36 | 0.662 |
| NM_002218 | M-017838-00 | ITIH4 | -1.65 | -0.33 | 0.668 |
| NM_000188 | M-006820-01 | HK1 | -2.21 | -0.05 | 0.678 |
| NM_015338 | M-012856-00 | ASXL1 | -1.86 | -0.39 | 0.680 |
| NM_019070 | M-017975-00 | DDX49 | -1.92 | -0.33 | 0.683 |
| NM_173853 | M-017757-00 | KRTCAP3 | -1.83 | -0.34 | 0.683 |
| XM_373109 | M-027171-00 | RP11-145H9.1 | -1.93 | 0.07 | 0.686 |
| NM_005544 | M-003015-01 | IRS1 | -1.57 | -0.47 | 0.695 |
| NM_007205 | M-032280-00 | TREX2 | -2.22 | -0.39 | 0.697 |
| NM_007358 | M-012796-00 | MTF2 | -2.11 | -0.40 | 0.699 |
| NM_173497 | M-007198-00 | HECTD2 | -1.66 | -0.39 | 0.705 |
| NM_003247 | M-019745-00 | THBS2 | -2.48 | -0.31 | 0.705 |
| NM_173846 | M-017754-00 | TPPP2 | -1.65 | 0.12 | 0.707 |
| XM_030729 | M-026260-00 | FAM22F | -1.72 | -0.23 | 0.714 |
| NM_015690 | M-005039-01 | STK36 | -1.55 | 0.46 | 0.718 |
| NM_002082 | M-004627-01 | GRK6 | -1.90 | 0.29 | 0.722 |
| NM_004673 | M-007804-01 | ANGPTL1 | -1.88 | 0.62 | 0.738 |
| NM_182755 | M-019384-00 | ZNF438 | -1.62 | 0.10 | 0.742 |

| Accession # | Fold_HMLER | BPLER_RSD | HMLER_RSD | Ratio | Cherry Score |
|---|---|---|---|---|---|
| NM_002696 | 0.74 | 0.07 | 0.05 | 0.69 | 3 |
| NM_018097 | 0.74 | 0.10 | 0.09 | 0.70 | 3 |
| XM_058073 | 0.75 | 0.02 | 0.05 | 0.73 | 3 |
| XM_375557 | 0.94 | 0.12 | 0.01 | 0.67 | 3 |
| NM_001253 | 0.87 | 0.05 | 0.12 | 0.75 | 3 |
| NM_006292 | 1.04 | 0.09 | 0.04 | 0.66 | 3 |
| NM_016937 | 0.97 | 0.05 | 0.04 | 0.74 | 3 |
| NM_032916 | 0.70 | 0.15 | 0.05 | 0.70 | 2 |
| NM_001237 | 0.75 | 0.07 | 0.05 | 0.67 | 2 |
| NM_016047 | 0.72 | 0.09 | 0.03 | 0.70 | 2 |
| NM_007364 | 0.80 | 0.16 | 0.04 | 0.68 | 2 |
| NM_014347 | 0.84 | 0.19 | 0.07 | 0.65 | 2 |
| NM_007263 | 0.77 | 0.06 | 0.03 | 0.71 | 2 |
| NM_005063 | 0.75 | 0.04 | 0.04 | 0.74 | 2 |

TABLE 2C-continued

| Modestly Selective siRNAs | | | | | |
|---|---|---|---|---|---|
| NM_032425 | 0.77 | 0.02 | 0.08 | 0.73 | 2 |
| NM_020860 | 0.83 | 0.05 | 0.04 | 0.72 | 2 |
| NM_018242 | 0.90 | 0.04 | 0.12 | 0.68 | 2 |
| NM_004336 | 0.91 | 0.08 | 0.03 | 0.67 | 2 |
| NM_152655 | 0.89 | 0.04 | 0.05 | 0.72 | 2 |
| NM_182640 | 0.92 | 0.06 | 0.07 | 0.72 | 2 |
| NM_022830 | 0.99 | 0.11 | 0.00 | 0.69 | 2 |
| XM_370928 | 0.95 | 0.08 | 0.03 | 0.71 | 2 |
| NM_152374 | 0.97 | 0.17 | 0.01 | 0.72 | 2 |
| NM_006590 | 0.99 | 0.05 | 0.05 | 0.70 | 2 |
| NM_016200 | 0.96 | 0.10 | 0.04 | 0.73 | 2 |
| NM_003981 | 0.60 | 0.18 | 0.19 | 0.68 | 1 |
| NM_020882 | 0.56 | 0.04 | 0.04 | 0.74 | 1 |
| NM_021974 | 0.56 | 0.08 | 0.08 | 0.74 | 1 |
| NM_018271 | 0.62 | 0.16 | 0.12 | 0.71 | 1 |
| XM_378175 | 0.66 | 0.12 | 0.13 | 0.70 | 1 |
| NM_014456 | 0.63 | 0.16 | 0.04 | 0.73 | 1 |
| NM_152496 | 0.64 | 0.08 | 0.05 | 0.72 | 1 |
| NM_174931 | 0.65 | 0.20 | 0.03 | 0.72 | 1 |
| XM_371354 | 0.82 | 0.13 | 0.07 | 0.65 | 1 |
| NM_004739 | 0.79 | 0.16 | 0.12 | 0.69 | 1 |
| NM_198080 | 0.85 | 0.09 | 0.08 | 0.67 | 1 |
| NM_000792 | 0.78 | 0.22 | 0.07 | 0.74 | 1 |
| NM_013366 | 0.79 | 0.07 | 0.03 | 0.74 | 1 |
| NM_001746 | 0.80 | 0.07 | 0.08 | 0.74 | 1 |
| NM_148571 | 0.81 | 0.20 | 0.04 | 0.73 | 1 |
| NM_002255 | 0.85 | 0.01 | 0.08 | 0.69 | 1 |
| NM_024762 | 0.80 | 0.03 | 0.05 | 0.75 | 1 |
| NM_052946 | 0.90 | 0.13 | 0.03 | 0.67 | 1 |
| NM_002636 | 0.86 | 0.10 | 0.12 | 0.71 | 1 |
| NM_015046 | 0.89 | 0.08 | 0.17 | 0.70 | 1 |
| NM_006204 | 0.95 | 0.08 | 0.07 | 0.66 | 1 |
| NM_001225 | 0.86 | 0.15 | 0.05 | 0.73 | 1 |
| NM_000172 | 0.95 | 0.07 | 0.06 | 0.66 | 1 |
| NM_002270 | 0.90 | 0.09 | 0.06 | 0.70 | 1 |
| NM_030969 | 0.90 | 0.11 | 0.02 | 0.71 | 1 |
| NM_020689 | 0.88 | 0.08 | 0.03 | 0.72 | 1 |
| NM_020395 | 0.88 | 0.13 | 0.03 | 0.72 | 1 |
| NM_021640 | 0.90 | 0.04 | 0.13 | 0.71 | 1 |
| NM_014750 | 0.90 | 0.15 | 0.05 | 0.72 | 1 |
| NM_194324 | 0.87 | 0.22 | 0.11 | 0.74 | 1 |
| NM_014420 | 0.89 | 0.23 | 0.04 | 0.74 | 1 |
| NM_012202 | 0.90 | 0.10 | 0.05 | 0.73 | 1 |
| NM_001797 | 0.90 | 0.05 | 0.11 | 0.73 | 1 |
| NM_002513 | 1.02 | 0.17 | 0.05 | 0.65 | 1 |
| NM_005954 | 0.97 | 0.04 | 0.08 | 0.69 | 1 |
| NM_000322 | 0.91 | 0.03 | 0.15 | 0.74 | 1 |
| NM_021960 | 0.98 | 0.07 | 0.01 | 0.69 | 1 |
| NM_000131 | 0.99 | 0.13 | 0.05 | 0.69 | 1 |
| NM_020380 | 0.92 | 0.07 | 0.05 | 0.75 | 1 |
| NM_022304 | 0.93 | 0.07 | 0.07 | 0.74 | 1 |
| NM_005003 | 0.97 | 0.01 | 0.04 | 0.72 | 1 |
| NM_032024 | 0.97 | 0.12 | 0.22 | 0.72 | 1 |
| NM_134444 | 1.01 | 0.17 | 0.04 | 0.69 | 1 |
| XM_371074 | 1.05 | 0.20 | 0.09 | 0.67 | 1 |
| NM_080730 | 0.99 | 0.03 | 0.02 | 0.72 | 1 |
| NM_005713 | 1.00 | 0.13 | 0.06 | 0.71 | 1 |
| NM_152905 | 1.08 | 0.06 | 0.02 | 0.67 | 1 |
| NM_020528 | 1.02 | 0.12 | 0.05 | 0.71 | 1 |
| NM_006156 | 1.04 | 0.12 | 0.08 | 0.71 | 1 |
| NM_012141 | 0.53 | 0.16 | 0.09 | 0.70 | 0 |
| NM_173626 | 0.64 | 0.08 | 0.03 | 0.65 | 0 |
| NM_003301 | 0.62 | 0.05 | 0.05 | 0.68 | 0 |
| NM_020809 | 0.63 | 0.05 | 0.02 | 0.69 | 0 |
| NM_004277 | 0.68 | 0.22 | 0.15 | 0.70 | 0 |
| NM_016082 | 0.73 | 0.09 | 0.09 | 0.66 | 0 |
| NM_030962 | 0.74 | 0.06 | 0.02 | 0.65 | 0 |
| NM_001538 | 0.72 | 0.02 | 0.06 | 0.71 | 0 |
| NM_173556 | 0.77 | 0.02 | 0.08 | 0.68 | 0 |
| XM_016548 | 0.71 | 0.10 | 0.03 | 0.74 | 0 |
| XM_056282 | 0.74 | 0.08 | 0.13 | 0.71 | 0 |
| NM_182703 | 0.74 | 0.17 | 0.13 | 0.72 | 0 |
| NM_005831 | 0.74 | 0.07 | 0.03 | 0.72 | 0 |
| NM_003526 | 0.77 | 0.12 | 0.06 | 0.70 | 0 |
| NM_005911 | 0.81 | 0.02 | 0.04 | 0.67 | 0 |
| NM_022567 | 0.84 | 0.12 | 0.02 | 0.66 | 0 |
| NM_018360 | 0.77 | 0.14 | 0.11 | 0.72 | 0 |
| NM_182558 | 0.79 | 0.13 | 0.21 | 0.71 | 0 |

TABLE 2C-continued

Modestly Selective siRNAs

| | | | | | |
|---|---|---|---|---|---|
| NM_016388 | 0.83 | 0.20 | 0.06 | 0.67 | 0 |
| NM_006413 | 0.78 | 0.15 | 0.09 | 0.71 | 0 |
| NM_024619 | 0.79 | 0.18 | 0.05 | 0.71 | 0 |
| NM_001937 | 0.84 | 0.18 | 0.02 | 0.67 | 0 |
| XM_375187 | 0.80 | 0.05 | 0.05 | 0.72 | 0 |
| NM_178168 | 0.81 | 0.03 | 0.08 | 0.71 | 0 |
| NM_020320 | 0.79 | 0.11 | 0.02 | 0.73 | 0 |
| NM_003685 | 0.82 | 0.15 | 0.13 | 0.71 | 0 |
| NM_152603 | 0.83 | 0.10 | 0.06 | 0.71 | 0 |
| XM_114430 | 0.85 | 0.14 | 0.19 | 0.69 | 0 |
| NM_198494 | 0.91 | 0.08 | 0.10 | 0.65 | 0 |
| NM_152465 | 0.82 | 0.06 | 0.08 | 0.73 | 0 |
| NM_152647 | 0.91 | 0.12 | 0.13 | 0.66 | 0 |
| NM_138451 | 0.83 | 0.14 | 0.10 | 0.73 | 0 |
| NM_024011 | 0.93 | 0.03 | 0.02 | 0.65 | 0 |
| NM_024647 | 0.81 | 0.09 | 0.03 | 0.75 | 0 |
| NM_152515 | 0.81 | 0.22 | 0.12 | 0.75 | 0 |
| NM_207401 | 0.83 | 0.21 | 0.05 | 0.73 | 0 |
| NM_144702 | 0.87 | 0.10 | 0.12 | 0.71 | 0 |
| XM_371575 | 0.86 | 0.10 | 0.01 | 0.73 | 0 |
| XM_209941 | 0.88 | 0.13 | 0.18 | 0.72 | 0 |
| NM_015446 | 0.90 | 0.11 | 0.06 | 0.71 | 0 |
| NM_019067 | 0.94 | 0.15 | 0.02 | 0.68 | 0 |
| NM_018922 | 0.89 | 0.05 | 0.18 | 0.71 | 0 |
| NM_032866 | 0.90 | 0.23 | 0.11 | 0.71 | 0 |
| NM_213604 | 0.88 | 0.09 | 0.08 | 0.73 | 0 |
| NM_018129 | 0.90 | 0.13 | 0.05 | 0.72 | 0 |
| NM_002510 | 0.87 | 0.05 | 0.06 | 0.73 | 0 |
| NM_004783 | 0.95 | 0.09 | 0.04 | 0.68 | 0 |
| XM_089747 | 0.89 | 0.09 | 0.12 | 0.74 | 0 |
| NM_173821 | 0.92 | 0.12 | 0.13 | 0.72 | 0 |
| NM_014891 | 0.99 | 0.11 | 0.06 | 0.67 | 0 |
| NM_005301 | 0.92 | 0.19 | 0.18 | 0.72 | 0 |
| NM_021049 | 0.95 | 0.03 | 0.07 | 0.70 | 0 |
| NM_002218 | 0.95 | 0.01 | 0.06 | 0.70 | 0 |
| NM_000188 | 0.99 | 0.12 | 0.02 | 0.68 | 0 |
| NM_015338 | 0.93 | 0.20 | 0.16 | 0.73 | 0 |
| NM_019070 | 0.96 | 0.11 | 0.01 | 0.71 | 0 |
| NM_173853 | 0.93 | 0.09 | 0.19 | 0.73 | 0 |
| XM_373109 | 1.01 | 0.21 | 0.12 | 0.68 | 0 |
| NM_005544 | 0.93 | 0.06 | 0.05 | 0.75 | 0 |
| NM_007205 | 0.94 | 0.18 | 0.07 | 0.74 | 0 |
| NM_007358 | 0.94 | 0.07 | 0.06 | 0.74 | 0 |
| NM_173497 | 0.94 | 0.08 | 0.03 | 0.75 | 0 |
| NM_003247 | 0.95 | 0.11 | 0.22 | 0.75 | 0 |
| NM_173846 | 1.01 | 0.10 | 0.11 | 0.70 | 0 |
| XM_030729 | 0.97 | 0.03 | 0.05 | 0.74 | 0 |
| NM_015690 | 1.07 | 0.18 | 0.01 | 0.67 | 0 |
| NM_002082 | 1.04 | 0.05 | 0.01 | 0.69 | 0 |
| NM_004673 | 1.11 | 0.04 | 0.18 | 0.67 | 0 |
| NM_182755 | 1.02 | 0.23 | 0.16 | 0.73 | 0 |

TABLE 3

Triple Negative Breast Cancer Gene Signature (TGS) Genes or Malignancy-Associated Response Signature (MARS) Genes

| Gene Symbol | SEQ ID NO: | Entrez Gene ID | Accession # | MAD BPLER | MAD HMLER | Fold BPLER | Fold HMLER | Ratio BPLER/HMLER | Cherry Score |
|---|---|---|---|---|---|---|---|---|---|
| PSMB4 | 1 | 5692 | NM_002796 | −6.73 | −2.41 | 0.147 | 0.52 | 0.28 | 4 |
| PSMA1 | 2 | 5682 | NM_002786 | −5.53 | −2.21 | 0.240 | 0.65 | 0.37 | 4 |
| RACGAP1 | 3 | 29127 | NM_013277 | −3.61 | −1.46 | 0.361 | 0.77 | 0.47 | 4 |
| PSMC3 | 4 | 5702 | NM_002804 | −1.77 | −1.02 | 0.399 | 0.81 | 0.49 | 4 |
| PRPF38A | 5 | 84950 | NM_032864 | −3.64 | −1.70 | 0.403 | 0.69 | 0.58 | 4 |
| DHX8 | 6 | 1659 | NM_004941 | −4.27 | −1.24 | 0.413 | 0.81 | 0.51 | 4 |
| PSMA3 | 7 | 5684 | NM_002788 | −1.72 | −0.54 | 0.434 | 0.90 | 0.48 | 4 |
| POLR2B | 8 | 5431 | NM_000938 | −4.09 | −1.97 | 0.438 | 0.69 | 0.63 | 4 |
| CCDC5 | 9 | 115106 | NM_138443 | −2.18 | −0.02 | 0.583 | 1.00 | 0.59 | 4 |
| LSM6 | 10 | 11157 | NM_007080 | −2.83 | −0.41 | 0.593 | 0.93 | 0.64 | 4 |
| PRPF6 | 11 | 24148 | NM_012469 | −3.13 | −1.23 | 0.508 | 0.81 | 0.62 | 3 |
| NUP205 | 12 | 23165 | XM_058073 | −2.88 | −1.57 | 0.544 | 0.75 | 0.73 | 3 |
| DDX19B | 13 | 11269 | NM_007242 | −4.84 | −2.09 | 0.304 | 0.66 | 0.46 | 3 |
| SNW1 | 14 | 22938 | NM_012245 | −5.45 | −1.31 | 0.335 | 0.75 | 0.45 | 3 |
| PSMD2 | 15 | 5708 | NM_002808 | −4.64 | −2.67 | 0.343 | 0.61 | 0.56 | 3 |

TABLE 3-continued

Triple Negative Breast Cancer Gene Signature (TGS) Genes or Malignancy-Associated Response Signature (MARS) Genes

| Gene Symbol | SEQ ID NO: | Entrez Gene ID | Accession # | MAD BPLER | MAD HMLER | Fold BPLER | Fold HMLER | Ratio BPLER/HMLER | Cherry Score |
|---|---|---|---|---|---|---|---|---|---|
| PSMD14 | 16 | 10213 | NM_005805 | −3.37 | −2.28 | 0.352 | 0.62 | 0.56 | 3 |
| NDC80 | 17 | 10403 | NM_006101 | −3.24 | −2.06 | 0.377 | 0.66 | 0.57 | 3 |
| C22orf29 | 18 | 79680 | NM_024627 | −3.47 | −2.46 | 0.400 | 0.62 | 0.64 | 3 |
| POLR2G | 19 | 5436 | NM_002696 | −3.59 | −1.68 | 0.507 | 0.74 | 0.69 | 3 |
| LSM2 | 20 | 57819 | NM_021177 | −2.90 | −0.95 | 0.512 | 0.84 | 0.61 | 3 |
| PSMD6 | 21 | 9861 | NM_014814 | −2.05 | −0.79 | 0.516 | 0.87 | 0.59 | 3 |
| CEP27 | 22 | 55142 | NM_018097 | −1.99 | −1.76 | 0.522 | 0.74 | 0.70 | 3 |
| C4orf15 | 23 | 79441 | NM_024511 | −2.52 | 0.55 | 0.560 | 1.09 | 0.52 | 3 |
| YTHDC1 | 24 | 91746 | NM_133370 | −2.31 | −0.26 | 0.567 | 0.96 | 0.59 | 3 |
| C19orf29 | 25 | 58509 | XM_375557 | −2.24 | −0.36 | 0.625 | 0.94 | 0.67 | 3 |
| CDC5L | 26 | 988 | NM_001253 | −1.60 | −0.87 | 0.654 | 0.87 | 0.75 | 3 |
| TSG101 | 27 | 7251 | NM_006292 | −2.45 | 0.23 | 0.684 | 1.04 | 0.66 | 3 |
| POLA1 | 28 | 5422 | NM_016937 | −2.01 | −0.17 | 0.724 | 0.97 | 0.74 | 3 |
| UBL5 | 29 | 59286 | NM_024292 | −4.14 | −2.33 | 0.337 | 0.64 | 0.53 | 2 |
| CCNA2 | 30 | 890 | NM_001237 | −2.79 | −1.39 | 0.499 | 0.75 | 0.67 | 2 |
| NUF2 | 31 | 83540 | NM_031423 | −2.68 | −0.90 | 0.515 | 0.84 | 0.62 | 2 |
| COPE | 32 | 11316 | NM_007263 | −3.15 | −1.43 | 0.547 | 0.77 | 0.71 | 2 |
| PSMA2 | 33 | 5683 | NM_002787 | −4.14 | −2.79 | 0.205 | 0.54 | 0.38 | 2 |
| PSMD7 | 34 | 5713 | NM_002811 | −3.88 | −2.86 | 0.256 | 0.53 | 0.49 | 2 |
| RAN | 35 | 5901 | NM_006325 | −5.67 | −2.89 | 0.266 | 0.57 | 0.47 | 2 |
| ISY1 | 36 | 57461 | NM_020701 | −4.27 | −2.95 | 0.306 | 0.54 | 0.56 | 2 |
| PPP2CA | 37 | 5515 | NM_002715 | −2.77 | −0.87 | 0.457 | 0.86 | 0.53 | 2 |
| PSMC1 | 38 | 5700 | NM_002802 | −1.50 | −0.45 | 0.476 | 0.91 | 0.52 | 2 |
| RBM22 | 39 | 55696 | NM_018047 | −2.37 | −1.53 | 0.477 | 0.78 | 0.61 | 2 |
| FAM86B1 | 40 | 85002 | NR_003494 NM_032916 (SEQ ID NO: 181) | −2.54 | −2.05 | 0.491 | 0.70 | 0.70 | 2 |
| SF3B14 | 41 | 51639 | NM_016047 | −2.97 | −2.06 | 0.500 | 0.72 | 0.70 | 2 |
| CCDC12 | 42 | 151903 | NM_144716 | −3.22 | −1.34 | 0.502 | 0.78 | 0.64 | 2 |
| ZNF451 | 43 | 26036 | NM_015555 | −3.07 | −0.77 | 0.516 | 0.86 | 0.60 | 2 |
| TMED3 | 44 | 23423 | NM_007364 | −2.93 | −1.28 | 0.537 | 0.80 | 0.68 | 2 |
| ZNF324 | 45 | 25799 | NM_014347 | −2.91 | −1.05 | 0.543 | 0.84 | 0.65 | 2 |
| SCD | 46 | 6319 | NM_005063 | −3.24 | −1.58 | 0.555 | 0.75 | 0.74 | 2 |
| KIAA1822 | 47 | 84439 | NM_032425 | −2.67 | −1.27 | 0.563 | 0.77 | 0.73 | 2 |
| CLTC | 48 | 1213 | NM_004859 | −2.02 | 0.05 | 0.570 | 1.01 | 0.57 | 2 |
| GAPDH | 49 | 2597 | NM_002046 | −4.30 | −0.19 | 0.576 | 0.97 | 0.60 | 2 |
| STIM2 | 50 | 57620 | NM_020860 | −2.39 | −0.99 | 0.597 | 0.83 | 0.72 | 2 |
| SLC47A1 | 51 | 55244 | NM_018242 | −1.62 | −0.71 | 0.613 | 0.90 | 0.68 | 2 |
| BUB1 | 52 | 699 | NM_004336 | −2.62 | −0.62 | 0.617 | 0.91 | 0.67 | 2 |
| ZNF585A | 53 | 199704 | NM_152655 | −2.06 | −0.70 | 0.642 | 0.89 | 0.72 | 2 |
| DNAJC11 | 54 | 55735 | NM_018198 | −1.52 | 0.75 | 0.656 | 1.11 | 0.59 | 2 |
| MRPS9 | 55 | 64965 | NM_182640 | −2.00 | −0.45 | 0.669 | 0.92 | 0.72 | 2 |
| SLC4A5 | 56 | 57835 | NM_021196 | −1.94 | 0.63 | 0.672 | 1.11 | 0.61 | 2 |
| TUT1 | 57 | 64852 | NM_022830 | −1.91 | −0.07 | 0.680 | 0.99 | 0.69 | 2 |
| TBC1D24 | 58 | 57465 | NM_020705 XM_370928 (SEQ ID NO: 182) | −1.97 | −0.32 | 0.680 | 0.95 | 0.71 | 2 |
| FLJ38984 | 59 | 127703 | NM_152374 | −1.50 | −0.23 | 0.693 | 0.97 | 0.72 | 2 |
| USP39 | 60 | 10713 | NM_006590 | −2.13 | −0.04 | 0.695 | 0.99 | 0.70 | 2 |
| LSM8 | 61 | 51691 | NM_016200 | −1.76 | −0.26 | 0.700 | 0.96 | 0.73 | 2 |
| RGS9BP | 62 | 388531 | NM_207391 | −1.58 | 0.53 | 0.707 | 1.10 | 0.64 | 2 |
| C6orf151 | 63 | 154007 | NM_152551 | −1.75 | 1.64 | 0.730 | 1.26 | 0.58 | 2 |
| COPB1 | 64 | 1315 | NM_016451 | −3.13 | −2.91 | 0.326 | 0.54 | 0.61 | 1 |
| ISYNA1 | 65 | 51477 | NM_016368 | −1.95 | −0.82 | 0.489 | 0.87 | 0.57 | 1 |
| FIZ1 | 66 | 84922 | NM_032836 | −2.97 | −0.32 | 0.514 | 0.94 | 0.55 | 1 |
| PDLIM2 | 67 | 64236 | NM_021630 | −2.65 | −0.34 | 0.563 | 0.95 | 0.60 | 1 |
| ANAPC2 | 68 | 29882 | NM_013366 | −2.80 | −1.31 | 0.580 | 0.79 | 0.74 | 1 |
| MGAT2 | 69 | 4247 | NM_002408 | −2.06 | −0.19 | 0.586 | 0.97 | 0.60 | 1 |
| MRPL27 | 70 | 51264 | NM_148571 | −1.57 | −1.17 | 0.587 | 0.81 | 0.73 | 1 |
| KIR2DL4 | 71 | 3805 | NM_002255 | −2.02 | −0.98 | 0.593 | 0.85 | 0.69 | 1 |
| ETHE1 | 72 | 23474 | NM_014297 | −2.19 | 1.03 | 0.641 | 1.17 | 0.55 | 1 |
| C12orf10 | 73 | 60314 | NM_021640 | −2.11 | −0.54 | 0.644 | 0.90 | 0.71 | 1 |
| RNF11 | 74 | 26994 | NM_014372 | −1.86 | 1.11 | 0.671 | 1.17 | 0.57 | 1 |
| FAM59B | 75 | 150946 | XM_097977 | −1.85 | 0.68 | 0.714 | 1.10 | 0.65 | 1 |
| NEDD8 | 76 | 4738 | NM_006156 | −1.79 | 0.25 | 0.736 | 1.04 | 0.71 | 1 |
| ZNF490 | 77 | 57474 | NM_020714 | −4.40 | −2.66 | 0.285 | 0.59 | 0.49 | 1 |
| DHRS13 | 78 | 147015 | NM_144683 | −3.66 | −1.69 | 0.350 | 0.75 | 0.47 | 1 |
| HNRPK | 79 | 3190 | NM_002140 | −3.35 | −2.71 | 0.358 | 0.55 | 0.65 | 1 |
| PRC1 | 80 | 9055 | NM_003981 | −3.08 | −2.40 | 0.409 | 0.60 | 0.68 | 1 |
| COL20A1 | 81 | 57642 | NM_020882 | −3.47 | −2.58 | 0.416 | 0.56 | 0.74 | 1 |
| POLR2F | 82 | 5435 | NM_021974 | −3.46 | −2.98 | 0.417 | 0.56 | 0.74 | 1 |
| DDX42 | 83 | 11325 | NM_007372 | −4.00 | −1.78 | 0.425 | 0.71 | 0.60 | 1 |

TABLE 3-continued

Triple Negative Breast Cancer Gene Signature (TGS) Genes or Malignancy-Associated Response Signature (MARS) Genes

| Gene Symbol | SEQ ID NO: | Entrez Gene ID | Accession # | MAD BPLER | MAD HMLER | Fold BPLER | Fold HMLER | Ratio BPLER/HMLER | Cherry Score |
|---|---|---|---|---|---|---|---|---|---|
| ZNF574 | 84 | 64763 | NM_022752 | −3.52 | −1.41 | 0.425 | 0.79 | 0.54 | 1 |
| FLJ10916 | 85 | 55258 | NM_018271 | −2.39 | −2.48 | 0.440 | 0.62 | 0.71 | 1 |
| TMEM41A | 86 | 90407 | NM_080652 | −2.70 | −1.83 | 0.457 | 0.73 | 0.63 | 1 |
| LOC124446 | 87 | 124446 | XM_378175 | −3.04 | −2.49 | 0.458 | 0.66 | 0.70 | 1 |
| PDCD4 | 88 | 27250 | NM_014456 | −2.81 | −2.25 | 0.462 | 0.63 | 0.73 | 1 |
| MANEAL | 89 | 149175 | NM_152496 | −3.02 | −2.41 | 0.464 | 0.64 | 0.72 | 1 |
| RB1CC1 | 90 | 9821 | NM_014781 | −3.21 | −1.50 | 0.466 | 0.74 | 0.63 | 1 |
| RFT1 | 91 | 91869 | NM_052859 | −2.82 | 0.04 | 0.468 | 1.01 | 0.47 | 1 |
| CCDC75 | 92 | 253635 | NM_174931 | −3.33 | −2.06 | 0.474 | 0.65 | 0.72 | 1 |
| ZNF643 | 93 | 65243 | NM_023070 | −3.05 | −0.52 | 0.493 | 0.92 | 0.54 | 1 |
| LIN9 | 94 | 286826 | NM_173083 | −2.90 | −0.72 | 0.525 | 0.90 | 0.59 | 1 |
| KIF26B | 95 | 55083 | NM_018012 XM_371354 (SEQ ID NO: 183) | −1.95 | −1.15 | 0.536 | 0.82 | 0.65 | 1 |
| MFSD5 | 96 | 84975 | NM_032889 | −2.81 | −0.38 | 0.540 | 0.93 | 0.58 | 1 |
| C16orf33 | 97 | 79622 | NM_024571 | −2.67 | −0.58 | 0.540 | 0.91 | 0.59 | 1 |
| SH3GL3 | 98 | 6457 | NM_003027 | −2.67 | −0.55 | 0.544 | 0.90 | 0.60 | 1 |
| MTA2 | 99 | 9219 | NM_004739 | −3.71 | −1.07 | 0.545 | 0.79 | 0.69 | 1 |
| PCTK2 | 100 | 5128 | NM_002595 | −2.29 | −0.79 | 0.552 | 0.87 | 0.64 | 1 |
| ANAPC4 | 101 | 29945 | NM_013367 | −2.96 | −0.79 | 0.557 | 0.87 | 0.64 | 1 |
| RBMX | 102 | 27316 | NM_002139 | −2.43 | −0.57 | 0.569 | 0.91 | 0.62 | 1 |
| DUS3L | 103 | 56931 | NM_020175 | −2.65 | −0.71 | 0.571 | 0.89 | 0.64 | 1 |
| MSRB3 | 104 | 253827 | NM_198080 | −2.72 | −0.86 | 0.571 | 0.85 | 0.67 | 1 |
| DCDC2 | 105 | 51473 | NM_016356 | −1.61 | −0.02 | 0.571 | 1.00 | 0.57 | 1 |
| LIN37 | 106 | 55957 | NM_019104 | −1.92 | −0.19 | 0.571 | 0.97 | 0.59 | 1 |
| DIO1 | 107 | 1733 | NM_000792 | −1.96 | −1.39 | 0.573 | 0.78 | 0.74 | 1 |
| CANX | 108 | 821 | NM_001746 | −1.92 | −1.38 | 0.587 | 0.80 | 0.74 | 1 |
| ZNF552 | 109 | 79818 | NM_024762 | −2.35 | −1.30 | 0.595 | 0.80 | 0.75 | 1 |
| NOSTRIN | 110 | 115677 | NM_052946 | −2.06 | −0.69 | 0.604 | 0.90 | 0.67 | 1 |
| PHF1 | 111 | 5252 | NM_002636 | −3.21 | −0.72 | 0.606 | 0.86 | 0.71 | 1 |
| GBP4 | 112 | 115361 | NM_052941 | −2.09 | −0.14 | 0.608 | 0.99 | 0.62 | 1 |
| DYSF | 113 | 8291 | NM_003494 | −2.13 | 0.64 | 0.614 | 1.12 | 0.55 | 1 |
| SETX | 114 | 23064 | NM_015046 | −2.40 | −0.72 | 0.617 | 0.89 | 0.70 | 1 |
| PDE6C | 115 | 5146 | NM_006204 | −1.98 | −0.33 | 0.621 | 0.95 | 0.66 | 1 |
| CASP4 | 116 | 837 | NM_001225 | −2.36 | −0.92 | 0.623 | 0.86 | 0.73 | 1 |
| GNAT1 | 117 | 2779 | NM_000172 | −2.03 | −0.36 | 0.627 | 0.95 | 0.66 | 1 |
| TNPO1 | 118 | 3842 | NM_002270 | −1.99 | −0.59 | 0.630 | 0.90 | 0.70 | 1 |
| KIAA1143 | 119 | 57456 | NM_020696 | −2.27 | 0.86 | 0.631 | 1.14 | 0.56 | 1 |
| TMEM14B | 120 | 81853 | NM_030969 | −1.99 | −0.56 | 0.636 | 0.90 | 0.71 | 1 |
| SLC24A3 | 121 | 57419 | NM_020689 | −2.23 | −0.75 | 0.637 | 0.88 | 0.72 | 1 |
| TMCO4 | 122 | 255104 | NM_181719 | −1.74 | −0.01 | 0.638 | 0.99 | 0.64 | 1 |
| INTS12 | 123 | 57117 | NM_020395 | −2.22 | −0.74 | 0.639 | 0.88 | 0.72 | 1 |
| DLG7 | 124 | 9787 | NM_014750 | −1.93 | −0.56 | 0.646 | 0.90 | 0.72 | 1 |
| MGC39900 | 125 | 286527 | NM_194324 | −2.13 | −0.87 | 0.647 | 0.87 | 0.74 | 1 |
| KCNJ6 | 126 | 3763 | NM_002240 | −1.88 | 0.12 | 0.654 | 1.04 | 0.63 | 1 |
| CDC2L5 | 127 | 8621 | NM_003718 | −2.34 | 0.95 | 0.656 | 1.13 | 0.58 | 1 |
| DKK4 | 128 | 27121 | NM_014420 | −1.90 | −0.72 | 0.657 | 0.89 | 0.74 | 1 |
| CDH11 | 129 | 1009 | NM_001797 | −1.56 | −0.69 | 0.663 | 0.90 | 0.73 | 1 |
| NME3 | 130 | 4832 | NM_002513 | −1.71 | 0.12 | 0.668 | 1.02 | 0.65 | 1 |
| SERPINB12 | 131 | 89777 | NM_080474 | −1.66 | 0.63 | 0.668 | 1.09 | 0.61 | 1 |
| MT3 | 132 | 4504 | NM_005954 | −1.77 | −0.16 | 0.672 | 0.97 | 0.69 | 1 |
| PRPH2 | 133 | 5961 | NM_000322 | −1.69 | −0.56 | 0.675 | 0.91 | 0.74 | 1 |
| MCL1 | 134 | 4170 | NM_021960 | −1.74 | −0.13 | 0.679 | 0.98 | 0.69 | 1 |
| F7 | 135 | 2155 | NM_000131 | −2.01 | −0.06 | 0.679 | 0.99 | 0.69 | 1 |
| C19orf20 | 136 | 91978 | NM_033513 | −1.69 | 0.87 | 0.684 | 1.13 | 0.61 | 1 |
| CASC5 | 137 | 570820 | NM_020380 | −1.86 | −0.56 | 0.686 | 0.92 | 0.75 | 1 |
| B3GNT6 | 138 | 192134 | NM_138706 | −1.80 | 0.45 | 0.691 | 1.07 | 0.65 | 1 |
| SAMD3 | 139 | 154075 | NM_152552 | −1.99 | 0.68 | 0.692 | 1.11 | 0.62 | 1 |
| HRH2 | 140 | 3274 | NM_022304 | −1.68 | −0.39 | 0.693 | 0.93 | 0.74 | 1 |
| NDUFAB1 | 141 | 4706 | NM_005003 | −1.82 | −0.20 | 0.694 | 0.97 | 0.72 | 1 |
| C10orf11 | 142 | 83938 | NM_032024 | −1.58 | −0.06 | 0.702 | 0.97 | 0.72 | 1 |
| NLRP4 | 143 | 147945 | NM_134444 | −1.68 | 0.11 | 0.702 | 1.01 | 0.69 | 1 |
| GPR15 | 144 | 2838 | NM_005290 | −1.58 | 0.72 | 0.708 | 1.11 | 0.64 | 1 |
| TANC2 | 145 | 26115 | NM_025185 XM_371074 (SEQ ID NO: 184) | −1.86 | 0.40 | 0.709 | 1.05 | 0.67 | 1 |
| HOM-TES-103 | 146 | 25900 | NM_080730 | −1.84 | −0.09 | 0.711 | 0.99 | 0.72 | 1 |
| FYCO1 | 147 | 794433 | NM_024513 | −1.67 | 0.86 | 0.714 | 1.13 | 0.63 | 1 |
| COL4A3BP | 148 | 10087 | NM_005713 | −1.96 | 0.03 | 0.715 | 1.00 | 0.71 | 1 |
| NEDD1 | 149 | 121441 | NM_152905 | −1.56 | 0.59 | 0.721 | 1.08 | 0.67 | 1 |

TABLE 3-continued

Triple Negative Breast Cancer Gene Signature (TGS) Genes or Malignancy-Associated Response Signature (MARS) Genes

| Gene Symbol | SEQ ID NO: | Entrez Gene ID | Accession # | MAD BPLER | MAD HMLER | Fold BPLER | Fold HMLER | Ratio BPLER/HMLER | Cherry Score |
|---|---|---|---|---|---|---|---|---|---|
| PCBP3 | 150 | 54039 | NM_020528 | −1.69 | 0.15 | 0.727 | 1.02 | 0.71 | 1 |
| PRPF8 | 151 | 10594 | NM_006445 | −5.34 | −2.64 | 0.246 | 0.62 | 0.40 | 1 |
| HIPK3 | 152 | 10114 | NM_005734 | −3.97 | −2.34 | 0.418 | 0.68 | 0.61 | 1 |
| PFKL | 153 | 5211 | NM_002626 | −1.85 | −0.10 | 0.630 | 0.98 | 0.64 | 1 |
| GNG3 | 154 | 2785 | NM_012202 | −1.86 | −0.62 | 0.658 | 0.90 | 0.73 | 1 |

TABLE 4A

Triple-negative Gene Signature

| Gene function | Gene Symbol | Entrez Gene ID | Accession # | MAD_BPLER | MAD_HMLER |
|---|---|---|---|---|---|
| Apoptosis | CASP4 | 837 | NM_001225 | −2.36 | −0.92 |
| Apoptosis | MCL1 | 4170 | NM_021960 | −1.74 | −0.13 |
| Apoptosis | PDCD4 | 27250 | NM_014456 | −2.81 | −2.25 |
| Cell Adhesion | CDH11 | 1009 | NM_001797 | −1.56 | −0.69 |
| Cell Adhesion | COL20A1 | 57642 | NM_020882 | −3.47 | −2.58 |
| Cell Adhesion | COL4A3BP | 10087 | NM_005713 | −1.96 | 0.03 |
| Cell Adhesion | PDLIM2 | 64236 | NM_021630 | −2.65 | −0.34 |
| Cell Signaling | DKK4 | 27121 | NM_014420 | −1.90 | −0.72 |
| Cell Signaling | MTA2 | 9219 | NM_004739 | −3.71 | −1.07 |
| Cell Signaling | PRPH2 | 5961 | NM_000322 | −1.69 | −0.56 |
| Cell Signaling | RACGAP1 | 29127 | NM_013277 | −3.61 | −1.46 |
| Cell Signaling | RGS9BP | 388531 | NM_207391 | −1.58 | 0.53 |
| Cell Signaling | TBC1D24 | 57465 | XM_370928 | −1.97 | −0.32 |
| DNA binding | FIZ1 | 84922 | NM_032836 | −2.97 | −0.32 |
| DNA binding | PHF1 | 5252 | NM_002636 | −3.21 | −0.72 |
| DNA binding | ZNF324 | 25799 | NM_014347 | −2.91 | −1.05 |
| DNA binding | ZNF451 | 26036 | NM_015555 | −3.07 | −0.77 |
| DNA binding | ZNF490 | 57474 | NM_020714 | −4.40 | −2.66 |
| DNA binding | ZNF552 | 79818 | NM_024762 | −2.35 | −1.30 |
| DNA binding | ZNF574 | 64763 | NM_022752 | −3.52 | −1.41 |
| DNA binding | ZNF585A | 199704 | NM_152655 | −2.06 | −0.70 |
| DNA binding | ZNF643 | 65243 | NM_023070 | −3.05 | −0.52 |
| DNA repair | GNAT1 | 2779 | NM_000172 | −2.03 | −0.36 |
| DNA repair | GNG3 | 2785 | NM_012202 | −1.86 | −0.62 |
| DNA repair | SETX | 23064 | NM_015046 | −2.40 | −0.72 |
| DNA repair | TSG101 | 7251 | NM_006292 | −2.45 | 0.23 |
| G1/S transition | CCNA2 | 890 | NM_001237 | −2.79 | −1.39 |
| G1/S transition | LIN37 | 55957 | NM_019104 | −1.92 | −0.19 |
| G1/S transition | LIN9 | 286826 | NM_173083 | −2.90 | −0.72 |
| G1/S transition | POLA1 | 5422 | NM_016937 | −2.01 | −0.17 |
| G1/S transition | RB1CC1 | 9821 | NM_014781 | −3.21 | −1.50 |
| Gene Expression | C16orf33 | 79622 | NM_024571 | −2.67 | −0.58 |
| Gene Expression | C6orf151 | 154007 | NM_152551 | −1.75 | 1.64 |
| Gene Expression | CCDC12 | 151903 | NM_144716 | −3.22 | −1.34 |
| Gene Expression | DDX42 | 11325 | NM_007372 | −4.00 | −1.78 |
| Gene Expression | DHX8 | 1659 | NM_004941 | −4.27 | −1.24 |
| Gene Expression | HIPK3 | 10114 | NM_005734 | −3.97 | −2.34 |
| Gene Expression | HNRPK | 3190 | NM_002140 | −3.35 | −2.71 |
| Gene Expression | MRPL27 | 51264 | NM_148571 | −1.57 | −1.17 |
| Gene Expression | MRPS9 | 64965 | NM_182640 | −2.00 | −0.45 |
| Gene Expression | POLR2B | 5431 | NM_000938 | −4.09 | −1.97 |
| Gene Expression | POLR2F | 5435 | NM_021974 | −3.46 | −2.98 |
| Gene Expression | POLR2G | 5436 | NM_002696 | −3.59 | −1.68 |
| Gene Expression | RBM22 | 55696 | NM_018047 | −2.37 | −1.53 |
| Gene Expression | RBMX | 27316 | NM_002139 | −2.43 | −0.57 |
| Gene Expression | SNW1 | 22938 | NM_012245 | −5.45 | −1.31 |
| Inflammation | HRH2 | 3274 | NM_022304 | −1.68 | −0.39 |
| Inflammation | KIR2DL4 | 3805 | NM_002255 | −2.02 | −0.98 |
| Inflammation | NLRP4 | 147945 | NM_134444 | −1.68 | 0.11 |
| Inflammation | NOSTRIN | 115677 | NM_052946 | −2.06 | −0.69 |
| Metabolism | B3GNT6 | 192134 | NM_138706 | −1.80 | 0.45 |
| Metabolism | DHRS13 | 147015 | NM_144683 | −3.66 | −1.69 |
| Metabolism | DIO1 | 1733 | NM_000792 | −1.96 | −1.39 |
| Metabolism | ETHE1 | 23474 | NM_014297 | −2.19 | 1.03 |
| Metabolism | GAPDH | 2597 | NM_002046 | −4.30 | −0.19 |
| Metabolism | GBP4 | 115361 | NM_052941 | −2.09 | −0.14 |
| Metabolism | ISYNA1 | 51477 | NM_016368 | −1.95 | −0.82 |
| Metabolism | KCNJ6 | 3763 | NM_002240 | −1.88 | 0.12 |

TABLE 4A-continued

| | Triple-negative Gene Signature | | | | |
|---|---|---|---|---|---|
| Metabolism | MGAT2 | 4247 | NM_002408 | −2.06 | −0.19 |
| Metabolism | MSRB3 | 253827 | NM_198080 | −2.72 | −0.86 |
| Metabolism | NDUFAB1 | 4706 | NM_005003 | −1.82 | −0.20 |
| Metabolism | PFKL | 5211 | NM_002626 | −1.85 | −0.10 |
| Metabolism | SCD | 6319 | NM_005063 | −3.24 | −1.58 |
| Mitosis | ANAPC2 | 29882 | NM_013366 | −2.80 | −1.31 |
| Mitosis | ANAPC4 | 29945 | NM_013367 | −2.96 | −0.79 |
| Mitosis | BUB1 | 699 | NM_004336 | −2.62 | −0.62 |
| Mitosis | C4orf15 | 79441 | NM_024511 | −2.52 | 0.55 |
| Mitosis | CASC5 | 57082 | NM_020380 | −1.86 | −0.56 |
| Mitosis | CCDC5 | 115106 | NM_138443 | −2.18 | −0.02 |
| Mitosis | CEP27 | 55142 | NM_018097 | −1.99 | −1.76 |
| Mitosis | DLG7 | 9787 | NM_014750 | −1.93 | −0.56 |
| Mitosis | NDC80 | 10403 | NM_006101 | −3.24 | −2.06 |
| Mitosis | NME3 | 4832 | NM_002513 | −1.71 | 0.12 |
| Mitosis | NUF2 | 83540 | NM_031423 | −2.68 | −0.90 |
| Mitosis | PPP2CA | 5515 | NM_002715 | −2.77 | −0.87 |
| Mitosis | PRC1 | 9055 | NM_003981 | −3.08 | −2.40 |
| Mitosis | RAN | 5901 | NM_006325 | −5.67 | −2.89 |
| Molecular Transport | CANX | 821 | NM_001746 | −1.92 | −1.38 |
| Molecular Transport | CLTC | 1213 | NM_004859 | −2.02 | 0.05 |
| Molecular Transport | COPB1 | 1315 | NM_016451 | −3.13 | −2.91 |
| Molecular Transport | COPE | 11316 | NM_007263 | −3.15 | −1.43 |
| Molecular Transport | DDX19B | 11269 | NM_007242 | −4.84 | −2.09 |
| Molecular Transport | FYCO1 | 79443 | NM_024513 | −1.67 | 0.86 |
| Molecular Transport | MFSD5 | 84975 | NM_032889 | −2.81 | −0.38 |
| Molecular Transport | NUP205 | 23165 | XM_058073 | −2.88 | −1.57 |
| Molecular Transport | RFT1 | 91869 | NM_052859 | −2.82 | 0.04 |
| Molecular Transport | SH3GL3 | 6457 | NM_003027 | −2.67 | −0.55 |
| Molecular Transport | SLC24A3 | 57419 | NM_020689 | −2.23 | −0.75 |
| Molecular Transport | SLC47A1 | 55244 | NM_018242 | −1.62 | −0.71 |
| Molecular Transport | SLC4A5 | 57835 | NM_021196 | −1.94 | 0.63 |
| Molecular Transport | TNPO1 | 3842 | NM_002270 | −1.99 | −0.59 |
| Proteasome Degradation | NEDD1 | 121441 | NM_152905 | −1.56 | 0.59 |
| Proteasome Degradation | NEDD8 | 4738 | NM_006156 | −1.79 | 0.25 |
| Proteasome Degradation | PSMA1 | 5682 | NM_002786 | −5.53 | −2.21 |
| Proteasome Degradation | PSMA2 | 5683 | NM_002787 | −4.14 | −2.79 |
| Proteasome Degradation | PSMA3 | 5684 | NM_002788 | −1.72 | −0.54 |
| Proteasome Degradation | PSMB4 | 5692 | NM_002796 | −6.73 | −2.41 |
| Proteasome Degradation | PSMC1 | 5700 | NM_002802 | −1.50 | −0.45 |
| Proteasome Degradation | PSMC3 | 5702 | NM_002804 | −1.77 | −1.02 |
| Proteasome Degradation | PSMD14 | 10213 | NM_005805 | −3.37 | −2.28 |
| Proteasome Degradation | PSMD2 | 5708 | NM_002808 | −4.64 | −2.67 |
| Proteasome Degradation | PSMD6 | 9861 | NM_014814 | −2.05 | −0.79 |
| Proteasome Degradation | PSMD7 | 5713 | NM_002811 | −3.88 | −2.86 |
| Proteasome Degradation | RNF11 | 26994 | NM_014372 | −1.86 | 1.11 |
| Proteasome Degradation | UBL5 | 59286 | NM_024292 | −4.14 | −2.33 |
| Proteasome Degradation | USP39 | 10713 | NM_006590 | −2.13 | −0.04 |
| RNA splicing | C22orf29 | 79680 | NM_024627 | −3.47 | −2.46 |

TABLE 4A-continued

Triple-negative Gene Signature

| | | | | | |
|---|---|---|---|---|---|
| RNA splicing | CDC2L5 | 8621 | NM_003718 | −2.34 | 0.95 |
| RNA splicing | CDC5L | 988 | NM_001253 | −1.60 | −0.87 |
| RNA splicing | INTS12 | 57117 | NM_020395 | −2.22 | −0.74 |
| RNA splicing | ISY1 | 57461 | NM_020701 | −4.27 | −2.95 |
| RNA splicing | LSM2 | 57819 | NM_021177 | −2.90 | −0.95 |
| RNA splicing | LSM6 | 11157 | NM_007080 | −2.83 | −0.41 |
| RNA splicing | LSM8 | 51691 | NM_016200 | −1.76 | −0.26 |
| RNA splicing | PRPF38A | 84950 | NM_032864 | −3.64 | −1.70 |
| RNA splicing | PRPF6 | 24148 | NM_012469 | −3.13 | −1.23 |
| RNA splicing | PRPF8 | 10594 | NM_006445 | −5.34 | −2.64 |
| RNA splicing | SF3B14 | 51639 | NM_016047 | −2.97 | −2.06 |
| RNA splicing | TUT1 | 64852 | NM_022830 | −1.91 | −0.07 |
| Unassigned (Blood clotting cascade/Hemostasis/ Protein metabolism) | F7 | 2155 | NM_000131 | −2.01 | −0.06 |
| Unassigned (coagulation) | SERPINB12 | 89777 | NM_080474 | −1.66 | 0.63 |
| Unassigned (development) | KIF26B | 55083 | XM_371354 | −1.95 | −1.15 |
| Unassigned (GPCRs, Class A Rhodopsin-like) | GPR15 | 2838 | NM_005290 | −1.58 | 0.72 |
| Unassigned (RNA binding) | PCBP3 | 54039 | NM_020528 | −1.69 | 0.15 |
| Unassigned (Target of EGFR1/TGF beta/TNF-alpha signaling, metal) | MT3 | 4504 | NM_005954 | −1.77 | −0.16 |
| Unassigned (Target of IL-1 singlaing) | DYSF | 8291 | NM_003494 | −2.13 | 0.64 |
| Unassigned (Target of TGF beta signaling) | PCTK2 | 5128 | NM_002595 | −2.29 | −0.79 |
| Unassigned | C10orf11 | 83938 | NM_032024 | −1.58 | −0.06 |
| Unassigned | C12orf10 | 60314 | NM_021640 | −2.11 | −0.54 |
| Unassigned | C19orf20 | 91978 | NM_033513 | −1.69 | 0.87 |
| Unassigned | C19orf29 | 58509 | XM_375557 | −2.24 | −0.36 |
| Unassigned | CCDC75 | 253635 | NM_174931 | −3.33 | −2.06 |
| Unassigned | DCDC2 | 51473 | NM_016356 | −1.61 | −0.02 |
| Unassigned | DNAJC11 | 55735 | NM_018198 | −1.52 | 0.75 |
| Unassigned | DUS3L | 56931 | NM_020175 | −2.65 | −0.71 |
| Unassigned | FAM59B | 150946 | XM_097977 | −1.85 | 0.68 |
| Unassigned | FAM86B1 | 85002 | NM_032916 | −2.54 | −2.05 |
| Unassigned | FLJ10916 | 55258 | NM_018271 | −2.39 | −2.48 |
| Unassigned | FLJ38984 | 127703 | NM_152374 | −1.50 | −0.23 |
| Unassigned | HOM-TES-103 | 25900 | NM_080730 | −1.84 | −0.09 |
| Unassigned | KIAA1143 | 57456 | NM_020696 | −2.27 | 0.86 |
| Unassigned | KIAA1822 | 84439 | NM_032425 | −2.67 | −1.27 |
| Unassigned | MANEAL | 149175 | NM_152496 | −3.02 | −2.41 |
| Unassigned | MGC39900 | 286527 | NM_194324 | −2.13 | −0.87 |
| Unassigned | PDE6C | 5146 | NM_006204 | −1.98 | −0.33 |
| Unassigned | SAMD3 | 154075 | NM_152552 | −1.99 | 0.68 |
| Unassigned | STIM2 | 57620 | NM_020860 | −2.39 | −0.99 |
| Unassigned | TANC2 | 26115 | XM_371074 | −1.86 | 0.40 |
| Unassigned | TMCO4 | 255104 | NM_181719 | −1.74 | −0.01 |
| Unassigned | TMED3 | 23423 | NM_007364 | −2.93 | −1.28 |
| Unassigned | TMEM14B | 81853 | NM_030969 | −1.99 | −0.56 |
| Unassigned | TMEM219 | 124446 | XM_378175 | −3.04 | −2.49 |
| Unassigned | TMEM41A | 90407 | NM_080652 | −2.70 | −1.83 |
| Unassigned | YTHDC1 | 91746 | NM_133370 | −2.31 | −0.26 |

| Gene function | Fold_BPLER | Fold_HMLER | Ratio BPLER/HMLER | Cherry_Score |
|---|---|---|---|---|
| Apoptosis | 0.623 | 0.86 | 0.73 | 1 |
| Apoptosis | 0.679 | 0.98 | 0.69 | 1 |
| Apoptosis | 0.462 | 0.63 | 0.73 | 1 |
| Cell Adhesion | 0.663 | 0.90 | 0.73 | 1 |
| Cell Adhesion | 0.416 | 0.56 | 0.74 | 1 |
| Cell Adhesion | 0.715 | 1.00 | 0.71 | 1 |
| Cell Adhesion | 0.563 | 0.95 | 0.60 | 1 |
| Cell Signaling | 0.657 | 0.89 | 0.74 | 1 |

TABLE 4A-continued

Triple-negative Gene Signature

| | | | | |
|---|---|---|---|---|
| Cell Signaling | 0.545 | 0.79 | 0.69 | 1 |
| Cell Signaling | 0.675 | 0.91 | 0.74 | 1 |
| Cell Signaling | 0.361 | 0.77 | 0.47 | 4 |
| Cell Signaling | 0.707 | 1.10 | 0.64 | 2 |
| Cell Signaling | 0.680 | 0.95 | 0.71 | 2 |
| DNA binding | 0.514 | 0.94 | 0.55 | 1 |
| DNA binding | 0.606 | 0.86 | 0.71 | 1 |
| DNA binding | 0.543 | 0.84 | 0.65 | 2 |
| DNA binding | 0.516 | 0.86 | 0.60 | 2 |
| DNA binding | 0.285 | 0.59 | 0.49 | 1 |
| DNA binding | 0.595 | 0.80 | 0.75 | 1 |
| DNA binding | 0.425 | 0.79 | 0.54 | 1 |
| DNA binding | 0.642 | 0.89 | 0.72 | 2 |
| DNA binding | 0.493 | 0.92 | 0.54 | 1 |
| DNA repair | 0.627 | 0.95 | 0.66 | 1 |
| DNA repair | 0.658 | 0.90 | 0.73 | 1 |
| DNA repair | 0.617 | 0.89 | 0.70 | 1 |
| DNA repair | 0.684 | 1.04 | 0.66 | 3 |
| G1/S transition | 0.499 | 0.75 | 0.67 | 2 |
| G1/S transition | 0.571 | 0.97 | 0.59 | 1 |
| G1/S transition | 0.525 | 0.90 | 0.59 | 1 |
| G1/S transition | 0.724 | 0.97 | 0.74 | 3 |
| G1/S transition | 0.466 | 0.74 | 0.63 | 1 |
| Gene Expression | 0.540 | 0.91 | 0.59 | 1 |
| Gene Expression | 0.730 | 1.26 | 0.58 | 2 |
| Gene Expression | 0.502 | 0.78 | 0.64 | 2 |
| Gene Expression | 0.425 | 0.71 | 0.60 | 1 |
| Gene Expression | 0.413 | 0.81 | 0.51 | 4 |
| Gene Expression | 0.418 | 0.68 | 0.61 | 1 |
| Gene Expression | 0.358 | 0.55 | 0.65 | 1 |
| Gene Expression | 0.587 | 0.81 | 0.73 | 1 |
| Gene Expression | 0.669 | 0.92 | 0.72 | 2 |
| Gene Expression | 0.438 | 0.69 | 0.63 | 4 |
| Gene Expression | 0.417 | 0.56 | 0.74 | 1 |
| Gene Expression | 0.507 | 0.74 | 0.69 | 3 |
| Gene Expression | 0.477 | 0.78 | 0.61 | 2 |
| Gene Expression | 0.569 | 0.91 | 0.62 | 1 |
| Gene Expression | 0.335 | 0.75 | 0.45 | 3 |
| Inflammation | 0.693 | 0.93 | 0.74 | 1 |
| Inflammation | 0.593 | 0.85 | 0.69 | 1 |
| Inflammation | 0.702 | 1.01 | 0.69 | 1 |
| Inflammation | 0.604 | 0.90 | 0.67 | 1 |
| Metabolism | 0.691 | 1.07 | 0.65 | 1 |
| Metabolism | 0.350 | 0.75 | 0.47 | 1 |
| Metabolism | 0.573 | 0.78 | 0.74 | 1 |
| Metabolism | 0.641 | 1.17 | 0.55 | 1 |
| Metabolism | 0.576 | 0.97 | 0.60 | 2 |
| Metabolism | 0.608 | 0.99 | 0.62 | 1 |
| Metabolism | 0.489 | 0.87 | 0.57 | 1 |
| Metabolism | 0.654 | 1.04 | 0.63 | 1 |
| Metabolism | 0.586 | 0.97 | 0.60 | 1 |
| Metabolism | 0.571 | 0.85 | 0.67 | 1 |
| Metabolism | 0.694 | 0.97 | 0.72 | 1 |
| Metabolism | 0.630 | 0.98 | 0.64 | 1 |
| Metabolism | 0.555 | 0.75 | 0.74 | 2 |
| Mitosis | 0.580 | 0.79 | 0.74 | 1 |
| Mitosis | 0.557 | 0.87 | 0.64 | 1 |
| Mitosis | 0.617 | 0.91 | 0.67 | 2 |
| Mitosis | 0.560 | 1.09 | 0.52 | 3 |
| Mitosis | 0.686 | 0.92 | 0.75 | 1 |
| Mitosis | 0.583 | 1.00 | 0.59 | 4 |
| Mitosis | 0.522 | 0.74 | 0.70 | 3 |
| Mitosis | 0.646 | 0.90 | 0.72 | 1 |
| Mitosis | 0.377 | 0.66 | 0.57 | 3 |
| Mitosis | 0.668 | 1.02 | 0.65 | 1 |
| Mitosis | 0.515 | 0.84 | 0.62 | 2 |
| Mitosis | 0.457 | 0.86 | 0.53 | 2 |
| Mitosis | 0.409 | 0.60 | 0.68 | 1 |
| Mitosis | 0.266 | 0.57 | 0.47 | 2 |
| Molecular Transport | 0.587 | 0.80 | 0.74 | 1 |
| Molecular Transport | 0.570 | 1.01 | 0.57 | 2 |
| Molecular Transport | 0.326 | 0.54 | 0.61 | 1 |
| Molecular Transport | 0.547 | 0.77 | 0.71 | 2 |
| Molecular | 0.304 | 0.66 | 0.46 | 3 |

TABLE 4A-continued

| Triple-negative Gene Signature | | | | |
|---|---|---|---|---|
| Molecular Transport | 0.714 | 1.13 | 0.63 | 1 |
| Molecular Transport | 0.540 | 0.93 | 0.58 | 1 |
| Molecular Transport | 0.544 | 0.75 | 0.73 | 3 |
| Molecular Transport | 0.468 | 1.01 | 0.47 | 1 |
| Molecular Transport | 0.544 | 0.90 | 0.60 | 1 |
| Molecular Transport | 0.637 | 0.88 | 0.72 | 1 |
| Molecular Transport | 0.613 | 0.90 | 0.68 | 2 |
| Molecular Transport | 0.672 | 1.11 | 0.61 | 2 |
| Molecular Transport | 0.630 | 0.90 | 0.70 | 1 |
| Proteasome Degradation | 0.721 | 1.08 | 0.67 | 1 |
| Proteasome Degradation | 0.736 | 1.04 | 0.71 | 1 |
| Proteasome Degradation | 0.240 | 0.65 | 0.37 | 4 |
| Proteasome Degradation | 0.205 | 0.54 | 0.38 | 2 |
| Proteasome Degradation | 0.434 | 0.90 | 0.48 | 4 |
| Proteasome Degradation | 0.147 | 0.52 | 0.28 | 4 |
| Proteasome Degradation | 0.476 | 0.91 | 0.52 | 2 |
| Proteasome Degradation | 0.399 | 0.81 | 0.49 | 4 |
| Proteasome Degradation | 0.352 | 0.62 | 0.56 | 3 |
| Proteasome Degradation | 0.343 | 0.61 | 0.56 | 3 |
| Proteasome Degradation | 0.516 | 0.87 | 0.59 | 3 |
| Proteasome Degradation | 0.256 | 0.53 | 0.49 | 2 |
| Proteasome Degradation | 0.671 | 1.17 | 0.57 | 1 |
| Proteasome Degradation | 0.337 | 0.64 | 0.53 | 2 |
| Proteasome Degradation | 0.695 | 0.99 | 0.70 | 2 |
| RNA splicing | 0.400 | 0.62 | 0.64 | 3 |
| RNA splicing | 0.656 | 1.13 | 0.58 | 1 |
| RNA splicing | 0.654 | 0.87 | 0.75 | 3 |
| RNA splicing | 0.639 | 0.88 | 0.72 | 1 |
| RNA splicing | 0.306 | 0.54 | 0.56 | 2 |
| RNA splicing | 0.512 | 0.84 | 0.61 | 3 |
| RNA splicing | 0.593 | 0.93 | 0.64 | 4 |
| RNA splicing | 0.700 | 0.96 | 0.73 | 2 |
| RNA splicing | 0.403 | 0.69 | 0.58 | 4 |
| RNA splicing | 0.508 | 0.81 | 0.62 | 3 |
| RNA splicing | 0.246 | 0.62 | 0.40 | 1 |
| RNA splicing | 0.500 | 0.72 | 0.70 | 2 |
| RNA splicing | 0.680 | 0.99 | 0.69 | 2 |
| Unassigned (Blood clotting cascade/Hemostasis/Protein metabolism) | 0.679 | 0.99 | 0.69 | 1 |
| Unassigned (coagulation) | 0.668 | 1.09 | 0.61 | 1 |
| Unassigned (development) | 0.536 | 0.82 | 0.65 | 1 |
| Unassigned (GPCRs, Class A Rhodopsin-like) | 0.708 | 1.11 | 0.64 | 1 |

TABLE 4A-continued

| Triple-negative Gene Signature | | | | |
|---|---|---|---|---|
| Unassigned (RNA binding) | 0.727 | 1.02 | 0.71 | 1 |
| Unassigned (Target of EGFR1/TGF beta/TNF-alpha signaling, metal) | 0.672 | 0.97 | 0.69 | 1 |
| Unassigned (Target of IL-1 singlaing) | 0.614 | 1.12 | 0.55 | 1 |
| Unassigned (Target of TGF beta signaling) | 0.552 | 0.87 | 0.64 | 1 |
| Unassigned | 0.702 | 0.97 | 0.72 | 1 |
| Unassigned | 0.644 | 0.90 | 0.71 | 1 |
| Unassigned | 0.684 | 1.13 | 0.61 | 1 |
| Unassigned | 0.625 | 0.94 | 0.67 | 3 |
| Unassigned | 0.474 | 0.65 | 0.72 | 1 |
| Unassigned | 0.571 | 1.00 | 0.57 | 1 |
| Unassigned | 0.656 | 1.11 | 0.59 | 2 |
| Unassigned | 0.571 | 0.89 | 0.64 | 1 |
| Unassigned | 0.714 | 1.10 | 0.65 | 1 |
| Unassigned | 0.491 | 0.70 | 0.70 | 2 |
| Unassigned | 0.440 | 0.62 | 0.71 | 1 |
| Unassigned | 0.693 | 0.97 | 0.72 | 2 |
| Unassigned | 0.711 | 0.99 | 0.72 | 1 |
| Unassigned | 0.631 | 1.14 | 0.56 | 1 |
| Unassigned | 0.563 | 0.77 | 0.73 | 2 |
| Unassigned | 0.464 | 0.64 | 0.72 | 1 |
| Unassigned | 0.647 | 0.87 | 0.74 | 1 |
| Unassigned | 0.621 | 0.95 | 0.66 | 1 |
| Unassigned | 0.692 | 1.11 | 0.62 | 1 |
| Unassigned | 0.597 | 0.83 | 0.72 | 2 |
| Unassigned | 0.709 | 1.05 | 0.67 | 1 |
| Unassigned | 0.638 | 0.99 | 0.64 | 1 |
| Unassigned | 0.537 | 0.80 | 0.68 | 2 |
| Unassigned | 0.636 | 0.90 | 0.71 | 1 |
| Unassigned | 0.458 | 0.66 | 0.70 | 1 |
| Unassigned | 0.457 | 0.73 | 0.63 | 1 |
| Unassigned | 0.567 | 0.96 | 0.59 | 3 |

TABLE 4B

Classification of Genes in TGS Gene Signature

| Apoptosis | Cell Adhesion | Cell Signaling | DNA binding | DNA repair | G1/S transition | Gene Expression |
|---|---|---|---|---|---|---|
| CASP4 | CDH11 | DKK4 | FIZ1 | GNAT1 | CCNA2 | C16orf33 |
| MCL1 | COL20A1 | MTA2 | PHF1 | GNG3 | LIN37 | C6orf151 |
| PDCD4 | COL4A3BP | PRPH2 | ZNF324 | SETX | LIN9 | CCDC12 |
| | PDLIM2 | RACGAP1 | ZNF451 | TSG101 | POLA1 | DDX42 |
| | | RGS9BP | ZNF490 | | RB1CC1 | DHX8 |
| | | TBC1D24 | ZNF552 | | | HIPK3 |
| | | | ZNF574 | | | HNRPK |
| | | | ZNF585A | | | MRPL27 |
| | | | ZNF643 | | | MRPS9 |
| | | | | | | POLR2B |
| | | | | | | POLR2F |
| | | | | | | POLR2G |
| | | | | | | RBM22 |
| | | | | | | RBMX |
| | | | | | | SNW1 |

| Inflammation | Metabolism | Mitosis | Molecular Transport | Proteasome Degradation | RNA splicing | Unassigned |
|---|---|---|---|---|---|---|
| HRH2 | B3GNT6 | ANAPC2 | CANX | NEDD1 | C22orf29 | F7 |
| KIR2DL4 | DHRS13 | ANAPC4 | CLTC | NEDD8 | CDC2L5 | SERPINB12 |
| NLRP4 | DIO1 | BUB1 | COPB1 | PSMA1 | CDC5L | KIF26B |
| NOSTRIN | ETHE1 | C4orf15 | COPE | PSMA2 | INTS12 | GPR15 |
| | GAPDH | CASC5 | DDX19B | PSMA3 | ISY1 | PCBP3 |
| | GBP4 | CCDC5 | FYCO1 | PSMB4 | LSM2 | MT3 |
| | ISYNA1 | CEP27 | MFSD5 | PSMC1 | LSM6 | DYSF |
| | KCNJ6 | DLG7 | NUP205 | PSMC3 | LSM8 | PCTK2 |

TABLE 4B-continued

Classification of Genes in TGS Gene Signature

| | | | | | |
|---|---|---|---|---|---|
| MGAT2 | NDC80 | RFT1 | PSMD14 | PRPF38A | C10orf11 |
| MSRB3 | NME3 | SH3GL3 | PSMD2 | PRPF6 | C12orf10 |
| NDUFAB1 | NUF2 | SLC24A3 | PSMD6 | PRPF8 | C19orf20 |
| PFKL | PPP2CA | SLC47A1 | PSMD7 | SF3B14 | C19orf29 |
| SCD | PRC1 | SLC4A5 | RNF11 | TUT1 | CCDC75 |
| | RAN | TNPO1 | UBL5 | | DCDC2 |
| | | | USP39 | | DNAJC11 |
| | | | | | DUS3L |
| | | | | | FAM59B |
| | | | | | FAM86B1 |
| | | | | | FLJ10916 |

TABLE 5

Perturbagens inducing a TGS-related signature (CMAP)

| Rank | CMAP name | Mean | N | Enrichment | p-value | Specificity | Percent non-null |
|---|---|---|---|---|---|---|---|
| 3 | trichostatin A | 0.381 | 182 | 0.439 | 0 | 0.4218 | 70 |
| 4 | methylergometrine | 0.604 | 4 | 0.896 | 0.0001 | 0 | 100 |
| 8 | piribedil | 0.581 | 4 | 0.83 | 0.00127 | 0.0089 | 100 |
| 11 | deferoxamine | 0.432 | 8 | 0.593 | 0.00309 | 0 | 87 |
| 13 | sulfametoxydiazine | 0.57 | 4 | 0.793 | 0.00354 | 0.0094 | 100 |
| 15 | diltiazem | 0.543 | 5 | 0.716 | 0.00433 | 0 | 80 |
| 16 | nabumetone | 0.526 | 4 | 0.78 | 0.0044 | 0.0065 | 100 |
| 18 | meptazinol | 0.548 | 4 | 0.764 | 0.00585 | 0.0079 | 100 |
| 19 | remoxipride | 0.53 | 4 | 0.759 | 0.00631 | 0.015 | 100 |
| 21 | adrenosterone | 0.48 | 4 | 0.735 | 0.00965 | 0.0217 | 100 |
| 24 | canavanine | 0.534 | 3 | 0.821 | 0.01148 | 0 | 100 |
| 25 | phthalylsulfathiazole | 0.504 | 5 | 0.662 | 0.01178 | 0.0974 | 80 |
| 26 | butacaine | 0.438 | 4 | 0.718 | 0.01281 | 0.0158 | 100 |
| 27 | gabapentin | 0.482 | 4 | 0.718 | 0.01307 | 0 | 100 |
| 37 | vorinostat | 0.339 | 12 | 0.42 | 0.0187 | 0.6181 | 66 |
| 40 | sulfabenzamide | 0.369 | 4 | 0.683 | 0.02174 | 0.0288 | 75 |
| 43 | conessine | 0.454 | 4 | 0.678 | 0.02335 | 0 | 75 |
| 45 | adenosine phosphate | 0.317 | 4 | 0.677 | 0.02381 | 0.0124 | 50 |
| 46 | loperamide | 0.288 | 6 | 0.566 | 0.02459 | 0.1616 | 66 |
| 49 | fludroxycortide | 0.441 | 5 | 0.608 | 0.02784 | 0.0238 | 80 |
| 51 | tacrine | 0.339 | 4 | 0.664 | 0.02896 | 0.0126 | 75 |
| 52 | flufenamic acid | 0.428 | 6 | 0.554 | 0.02994 | 0.0365 | 83 |
| 54 | practolol | 0.435 | 4 | 0.657 | 0.03209 | 0.0259 | 75 |
| 56 | 4,5-dianilinophthalimide | 0.554 | 2 | 0.869 | 0.03493 | 0.0407 | 100 |
| 59 | 0316684-0000 | 0.298 | 4 | 0.644 | 0.03893 | 0.0192 | 50 |
| 60 | resveratrol | 0.332 | 9 | 0.439 | 0.04238 | 0.4363 | 55 |
| 62 | STOCK1N-28457 | 0.461 | 3 | 0.717 | 0.04465 | 0.0174 | 100 |
| 65 | pipemidic acid | 0.387 | 3 | 0.715 | 0.04543 | 0.0238 | 66 |
| 66 | hesperetin | 0.486 | 5 | 0.571 | 0.04588 | 0.0325 | 80 |
| 67 | vigabatrin | 0.313 | 3 | 0.712 | 0.04649 | 0.1529 | 66 |
| 69 | triamterene | 0.374 | 5 | 0.569 | 0.04724 | 0.0403 | 60 |
| 70 | biotin | 0.352 | 3 | 0.711 | 0.04745 | 0.0074 | 66 |
| 72 | amikacin | 0.365 | 4 | 0.627 | 0.04828 | 0.0089 | 50 |
| 75 | CP-690334-01 | 0.177 | 8 | 0.454 | 0.04924 | 0.2 | 50 |
| 76 | methyldopa | 0.391 | 5 | 0.566 | 0.04948 | 0.031 | 60 |
| 77 | cetirizine | 0.441 | 4 | 0.625 | 0.04957 | 0.0857 | 75 |
| 78 | 5252917 | 0.545 | 2 | 0.843 | 0.04982 | 0.0959 | 100 |

TABLE 6

CMAP transcripts decreased in breast cancer cells after treatment with Trichostatin A (Instance ID 6709)

| Probe Set ID | Gene Symbol | Rank | Score | Amplitude |
|---|---|---|---|---|
| 201267_s_at | PSMC3 | 22265 | 0.001 | −1.66 |
| 200796_s_at | MCL1 | 22207 | −0.002 | −1.46 |
| 209055_s_at | CDC5L | 21939 | 0.004 | −1.19 |
| AFFX-HUMGAPDH/M33197_5_at | GAPDH | 21909 | 0 | −1.17 |
| 215424_s_at | SNW1 | 21890 | −0.005 | −1.16 |
| 202731_at | PDCD4 | 21746 | −0.005 | −1.07 |
| 204162_at | NDC80 | 21731 | −0.01 | −1.07 |
| 201705_at | PSMD7 | 21564 | −0.008 | −1.01 |
| 211162_x_at | SCD | 21329 | −0.003 | −0.92 |
| 207318_s_at | CDK13 | 21150 | −0.001 | −0.87 |
| 215509_s_at | BUB1 | 21032 | −0.001 | −0.84 |
| 203418_at | CCNA2 | 20991 | −0.005 | −0.83 |
| 211708_s_at | SCD | 20983 | −0.011 | −0.83 |
| 208853_s_at | CANX | 20890 | −0.012 | −0.81 |
| 207319_s_at | CDK13 | 20833 | −0.015 | −0.79 |
| 212861_at | MFSD5 | 20698 | −0.015 | −0.77 |
| 218134_s_at | RBM22 | 20612 | −0.017 | −0.75 |
| 203444_s_at | MTA2 | 20562 | −0.032 | −0.74 |
| 206474_at | CDK17 | 20587 | −0.027 | −0.74 |
| 210759_s_at | PSMA1 | 20591 | −0.022 | −0.74 |
| 202576_s_at | DDX19A /// DDX19B | 20554 | −0.037 | −0.73 |
| 221573_at | C7orf25 /// PSMA2 | 20330 | −0.033 | −0.7 |
| 209226_s_at | TNPO1 | 20264 | −0.036 | −0.68 |
| 201102_s_at | PFKL | 20192 | −0.044 | −0.67 |
| 203101_s_at | MGAT2 | 20193 | −0.038 | −0.67 |
| 218009_s_at | PRC1 | 20166 | −0.049 | −0.67 |
| 221918_at | CDK17 | 20122 | −0.052 | −0.66 |
| 212247_at | NUP205 | 20070 | −0.056 | −0.65 |
| 211565_at | SH3GL3 | 20018 | −0.059 | −0.64 |
| 201532_at | PSMA3 | 19951 | −0.062 | −0.63 |
| 213226_at | CCNA2 | 19947 | −0.068 | −0.63 |
| AFFX-HUMGAPDH/M33197_M_at | GAPDH | 19837 | −0.068 | −0.62 |
| 204862_s_at | NME3 | 19691 | −0.068 | −0.6 |
| 213762_x_at | RBMX | 19570 | −0.068 | −0.58 |
| 217829_s_at | USP39 | 19438 | −0.068 | −0.56 |
| 208852_s_at | CANX | 19388 | −0.071 | −0.55 |
| 204219_s_at | PSMC1 | 19242 | −0.07 | −0.53 |
| 200749_at | — | 18994 | −0.065 | −0.5 |
| 218204_s_at | FYCO1 | 18978 | −0.07 | −0.5 |
| 218220_at | C12orf10 | 18967 | −0.075 | −0.5 |
| 215954_s_at | C19orf29 | 18872 | −0.077 | −0.49 |
| 200750_s_at | RAN | 18834 | −0.087 | −0.48 |
| 221452_s_at | TMEM14B | 18856 | −0.082 | −0.48 |
| 215792_s_at | DNAJC11 | 18761 | −0.089 | −0.47 |
| 219119_at | NAA38 | 18734 | −0.094 | −0.47 |
| 210148_at | HIPK3 | 18651 | −0.096 | −0.46 |
| 203334_at | DHX8 | 18517 | −0.101 | −0.45 |
| 211746_x_at | PSMA1 | 18546 | −0.097 | −0.45 |
| 209449_at | LSM2 | 18476 | −0.105 | −0.44 |
| 202243_s_at | PSMB4 | 18410 | −0.108 | −0.43 |
| 209511_at | POLR2F | 18356 | −0.111 | −0.43 |
| 218660_at | DYSF | 18347 | −0.116 | −0.43 |
| 207657_x_at | TNPO1 | 18249 | −0.124 | −0.42 |
| 208837_at | TMED3 | 18268 | −0.119 | −0.42 |
| 201317_s_at | PSMA2 | 18181 | −0.126 | −0.41 |
| 201676_x_at | PSMA1 | 18061 | −0.127 | −0.4 |

REFERENCES

1. Foulkes, W. D., Smith, I. E. & Reis-Filho, J. S. Triple-negative breast cancer. *N Engl J Med* 363, 1938-1948 (2010).

2. Gusterson, B. Do 'basal-like' breast cancers really exist? *Nat Rev Cancer* 9, 128-134 (2009).

3. Visvader, J. E. Cells of origin in cancer. *Nature* 469, 314-322 (2011).

4. Molyneux, G., et al. BRCA1 basal-like breast cancers originate from luminal epithelial progenitors and not from basal stem cells. *Cell Stem Cell* 7, 403-417 (2010).

5. Li, Z., et al. ETV6-NTRK3 fusion oncogene initiates breast cancer from committed mammary progenitors via activation of AP1 complex. *Cancer Cell* 12, 542-558 (2007).

6. Jiang, Z., et al. Rb deletion in mouse mammary progenitors induces luminal-B or basal-like/EMT tumor subtypes depending on p53 status. *J Clin Invest* 120, 3296-3309 (2010).

7. Honeth, G., et al. The CD44+/CD24− phenotype is enriched in basal-like breast tumors. *Breast Cancer Res* 10, R53 (2008).

8. Park, S. Y., et al. Heterogeneity for Stem Cell-Related Markers According to Tumor Subtype and Histologic Stage in Breast Cancer. *Clin Cancer Res* 16, 876-887 (2010).

9. Al-Hajj, M., Wicha, M. S., Benito-Hernandez, A., Morrison, S. J. & Clarke, M. F. Prospective identification of tumorigenic breast cancer cells. *Proc Natl Acad Sci USA* 100, 3983-3988 (2003).

10. Ince, T., et al. Transformation of Different Human Breast Epithelial Cell Types Leads to Distinct Tumor Phenotypes. *Cancer Cell* 12, 160-170 (2007).

11. Rakha, E. A. & Ellis, I. O. Triple-negative/basal-like breast cancer: review. *Pathology* 41, 40-47 (2009).

12. Prat, A., et al. Phenotypic and molecular characterization of the claudin-low intrinsic subtype of breast cancer. *Breast Cancer Res* 12, R68 (2010).

13. Richardson, A. L., et al. X chromosomal abnormalities in basal-like human breast cancer. *Cancer Cell* 9, 121-132 (2006).

14. van de Vijver, M. J., et al. A gene-expression signature as a predictor of survival in breast cancer. *N Engl J Med.* 347, 1999-2009 (2002)

15. Wang, Y., et al. Gene-expression profiles to predict distant metastasis of lymph-node-negative primary breast cancer. *Lancet* 365, 671-679 (2005).

16. Carroll, J. S., et al. Genome-wide analysis of estrogen receptor binding sites. *Nat Genet.* 38, 1289-1297 (2006).

17. Croft, D., et al. Reactome: a database of reactions, pathways and biological processes. *Nucleic Acids Res* 39, D691-697 (2011).

18. Kanehisa, M., Goto, S., Furumichi, M., Tanabe, M. & Hirakawa, M. KEGG for representation and analysis of molecular networks involving diseases and drugs. *Nucleic Acids Res* 38, D355-360 (2010).

19. Pico, A. R., et al. WikiPathways: pathway editing for the people. *PLoS Biol* 6, e184 (2008).

20. Warde-Farley, D., et al. The GeneMANIA prediction server: biological network integration for gene prioritization and predicting gene function. *Nucleic Acids Res* 38, W214-220 (2010).

21. Locasale, J. W., Vander Heiden, M. G. & Cantley, L. C. Rewiring of glycolysis in cancer cell metabolism. *Cell Cycle* 9, 4253 (2010).

22. Lamb, J., et al. The Connectivity Map: using gene-expression signatures to connect small molecules, genes, and disease. *Science* 313, 1929-1935 (2006).
23. Lamb, J. The Connectivity Map: a new tool for biomedical research. *Nat Rev Cancer* 7, 54-60 (2007).
24. Baur, J. A. & Sinclair, D. A. Therapeutic potential of resveratrol: the in vivo evidence. *Nat Rev Drug Discov* 5, 493-506 (2006).
25. Gomez-Bougie, P., et al. Noxa up-regulation and Mcl-1 cleavage are associated to apoptosis induction by bortezomib in multiple myeloma. *Cancer Res* 67, 5418-5424 (2007).
26. Cohen, P. & Tcherpakov, M. Will the Ubiquitin System Furnish as Many Drug Targets as Protein Kinases? *Cell* 143, 686-693 (2010).
27. Irvin, W. J., et al. Phase II Study of Bortezomib and Pegylated Liposomal Doxorubicin in the Treatment of Metastatic Breast Cancer. *Clin Breast Cancer* 10, 465-470 (2010).
28. Cresta, S., et al. Phase I study of bortezomib with weekly paclitaxel in patients with advanced solid tumours. *Eur J Cancer* 44, 1829-1834 (2008).
29. Awada, A., et al. Bortezomib/docetaxel combination therapy in patients with anthracycline-pretreated advanced/metastatic breast cancer: a phase I/II dose-escalation study. *Br J Cancer* 98, 1500-1507 (2008).
30. Gupta, P. B., et al. Identification of Selective Inhibitors of Cancer Stem Cells by High-Throughput Screening. *Cell*, 1-15 (2009).
31. Harley, M. E., Allan, L. A., Sanderson, H. S. & Clarke, P. R. Phosphorylation of Mcl-1 by CDK1-cyclin B1 initiates its Cdc20-dependent destruction during mitotic arrest. *EMBO J* 29, 2407-2420 (2010).
32. Luo, J., et al. A Genome-wide RNAi Screen Identifies Multiple Synthetic Lethal Interactions with the Ras Oncogene. *Cell* 137, 835-848 (2009).
33. Yu, F., et al. let-7 regulates self renewal and tumorigenicity of breast cancer cells. *Cell* 131, 1109-1123 (2007).
34. Molyneux, G. & Smalley, M. J. The Cell of Origin of BRCA1 Mutation-associated Breast Cancer: A Cautionary Tale of Gene Expression Profiling. *J Mammary Gland Biol Neoplasia* (2011).
35. Chaffer, C. L. & Weinberg, R. A. Cancer cell of origin: spotlight on luminal progenitors. *Cell Stem Cell* 7, 271-272 (2010).
36. Manie, E., et al. High frequency of TP53 mutation in BRCA1 and sporadic basal-like carcinomas but not in BRCA1 luminal breast tumors. *Cancer Res* 69, 663-671 (2009).
37. Trere, D., et al. High prevalence of retinoblastoma protein loss in triple-negative breast cancers and its association with a good prognosis in patients treated with adjuvant chemotherapy. *Ann Oncol* 20, 1818-1823 (2009).
38. Loboda, A., et al. A gene expression signature of RAS pathway dependence predicts response to PI3K and RAS pathway inhibitors and expands the population of RAS pathway activated tumors. *BMC Med Genomics* 3, 26 (2010).
39. Quintana, E., et al. Efficient tumour formation by single human melanoma cells. *Nature* 456, 593-598 (2008).
40. Killcoyne, S., Carter, G. W., Smith, J. & Boyle, J. Cytoscape: a community-based framework for network modeling. *Methods Mol Biol* 563, 219-239 (2009).
41. Petrocca, F., et al. E2F1-regulated microRNAs impair TGFbeta-dependent cell-cycle arrest and apoptosis in gastric cancer. *Cancer Cell* 13, 272-286 (2008).
42. Birmingham, A., et al. Statistical methods for analysis of high-throughput RNA interference screens. *Nat Methods* 6, 569-575 (2009).
43. Verhaak, R. G., et al. Prediction of molecular subtypes in acute myeloid leukemia based on gene expression profiling. *Haematologica* 94, 131-134 (2009).
44. Zhang, J. H., Chung, T. D. & Oldenburg, K. R. A Simple Statistical Parameter for Use in Evaluation and Validation of High Throughput Screening Assays. *J Biomol Screen* 4, 67-73 (1999).

SEQUENCE LISTING (184 sequences)

SEQ ID NO: 1 - DNA, 925 bp, Homo sapiens
ttttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatg

SEQ ID NO: 2 - DNA, 1281 bp, Homo sapiens
gatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaaaaaaa

SEQ ID NO: 3 - DNA, 3315 bp, Homo sapiens
aataaatttctctgtgattggttggtgaaggttttcaaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatgagtcatggaatttaagtgatttactgaagattatactactggtagatagaagagctaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 4 - DNA, 1618 bp, Homo sapiens
gtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgccaaaaaaaaaaaaaaaaaaaaaaaaaaaaaaaaaaaaaa

SEQ ID NO: 5 - DNA, 2780 bp, Homo sapiens
aacatgcagccgccatcattgattcgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatcttatttgagctttcatattcttcaatggttcctttcgtaatacctgagttaataaaagtggtctgaaagagctcttacggtttctgatagaactatataggactaccttttaagattaaatataagcatctgtacgtaaatgtaaaaaaaaa

SEQ ID NO: 6 - DNA, 4201 bp, Homo sapiens
agaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccgggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaagg

SEQ ID NO: 7 - DNA, 1014 bp, Homo sapiens
gttattggttggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattaaaaaaaaaaaaaaaa

SEQ ID NO: 8 - DNA, 3748 bp, Homo sapiens
cttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcacgaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttataaaaatgacaaatatgtactgtgttgtgataaaaagtattttatttgtttaatgatatgcatgcttttcttctgtaaatatataataaatttttgtagatagtcttgatgtgtg

SEQ ID NO: 9 - DNA, 1145 bp, Homo sapiens
ggcgtgtgggcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctcttaaaaaaaaaaaaaaaaaaaaa

SEQ ID NO: 10 - DNA, 789 bp, Homo sapiens
gagaagagcactgattggctgaggcagaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggaggaatcctcctttattgcaaa

SEQ ID NO: 11 - DNA, 3120 bp, Homo sapiens
gggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaaaaaaaaaaaaaaaaaaaaa

SEQ ID NO: 12 - DNA, 6232 bp, Homo sapiens
atggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcactctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaaggaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaac

SEQ ID NO: 13 - DNA, 1831 bp, Homo sapiens
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaaaaaaaaaaaaaaaaaa

SEQ ID NO: 14 - DNA, 2146 bp, Homo sapiens
cgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaaaaaaaaaaaaaaaa

SEQ ID NO: 15 - DNA, 2990 bp, Homo sapiens
tgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaggaaaaaaaaaaaaaaaaaaaaaaaaaaaaaaaaaaaaaaaaaaaaaaaaaaaaaaaaaaaaaaaaaaaa

SEQ ID NO: 16 - DNA, 1734 bp, Homo sapiens
aagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagacagagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtctaaaaaaaaaaaaaaaaaa

SEQ ID NO: 17 - DNA, 2209 bp, Homo sapiens
actgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtaaaaaaaaaaaaaaaaaaaaaaaaaaaaaaaaaaaaaa

SEQ ID NO: 18 - DNA, 6693 bp, Homo sapiens
gagcaggcgttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaagccactgaaaaaaaaaaaaaaaaaaaaaaaaaaaaaaaaaaaaaaaaaaaaaaaaaaaaaaaaaaa

SEQ ID NO: 19 - DNA, 852 bp, Homo sapiens
ctcctagtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaa

SEQ ID NO: 20 - DNA, 880 bp, Homo sapiens
ccctttcccggcttcctcctcccctctactctacccagcttgcgctccccagccgcaagtcggccgcgctttgcccgtcagcgcttggagctttctgcgtcgcttcccgctgcgcctgcgcggtcccgcctcgccccacgcgcgggctcgcgcttcggtttccccagacctgctcgcagcaccctgctgtcttcccggtccggcccgctgcccgcggcgccagcaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaatttg

SEQ ID NO: 21 - DNA, 1308 bp, Homo sapiens
gtcagccgctgtccccttagccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttc

SEQ ID NO: 22 - DNA, 3953 bp, Homo sapiens
gtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcaagtgatcctcccacctcagcctcccaagtagctgggactataggcacgcgccaccacgcctggctaatttttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaa

SEQ ID NO: 23 - DNA, 5620 bp, Homo sapiens
ctcccgtgaggcagtgcgaggcgcgcggggcacggagggcggtggcggcgggctcctgcgagaagcaagcggaacttcctgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacgaaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaatttgaggtcaatggaacatttaatttgatgaattgaactattatattaatttgtcttttttctcatgtagtacattcagaataccagtgctttttatgacttgagcatgtgtttagtggtacttagtcctggtaattttttacttacagggaaaaagcattattacataatgcaaatattttttaatatagttatctctctcctttttagaaatagaaattttctgccgttaaatttttttttgagatagagtctcactctgtctccaggctggaatgcagtggcacgatcttggctcactgcaacctctgcctcccgggttcaagtgattctcctgcctcagcctcccaagtagctgggactacaggcgcacaccgccacacccagctaatttttttgtattttagtagaaaaggggtttcaccatgttggccaggatggtctcaatctcttgacctcttgatcccctctcccggcctcccaaagtgccggaattacaggcatgagccaccacgctcagccgctattaaatattttaaaatgtgtagaacttctagtcagcatttttaaatctgtagaccttaatatgtgaaatagccaagtcccctcatgtttgactgtcaaataaaattctgctgctcaaattgtattcctccataattccctgctatagacctttaggctgttttaatgtccctacttgtaccacagagtattaggacttccttggcctgcctgcattcattttagagtctgaattctggggactcaaaagtttctacaagacagctgagcagtgctttgactttaatgtgacttacacatcataaatgactttcaaatgaaatttgaatttcaaaattctgtaaaagtggttgctcaaaggatgtatgatactattttaatcagtttaagagcaaaaatgtctaattgtatttaacaatggtatttgggcagccagaaaatattttaagcgttgctctaaaataatttgaagtagctcatctgttattacatcagatgcttcttgagtgcccaatttatacatggcctgtggtaaataccatgtgagctttgtaggaatacctttaagaatattcctcacctgttcgtaatatggaatgccaatctaaaaactacatgttttgggtggtctttatggaattttttagctataaccatcagaaaacaggcatacctagatgacagatgaaccttcttgatttttgaaacccattgaacaaaaatattttgccaattattgtgtttatgttatttaaaattttatgtaaaccttaattttgtagcagtaaattttgtttaagattttgctatcagctccctatcacctgagcaactttttttttgttgtatatgtttttttctattctatttcggaatagagaatttacttaaaatttttattttctccaaaaatgtggaaaatatgtcacctggtttcctggtttatggtagcatattctgtttaaattagtgtcacatatttagatgtgtggccagacgcttgatttattagttaatttttgagacagagtctaactgtgtcactcaggctggagttcagtggaatgatctcggctcactgcaacctccgcctcccaggttcaagtgattctcctgcttcagcctcctgagtagatgggattgtaggcgtgcaccactgcacctggctaatttttgtattttcagtagagacggggtttcaccatgttggtcaggctggtctcaaactcctgacctcaagtgatctacccgccttggccttccatagtgctggcattacaggtgtaagccaccatgcccctgcccagatgcttgatttatactgtccccacccaaaccttgacttgctcagcccagggggccagcagggcagatcaaggcacggatggtagttgtgtgtctgccgtaattacccaagttacttataatcgttgtgttactaggtaggtttatttgaagatttatttatttatttatttattttttattttttgagacggagtttcactcttgttgcccaggctggagtgcagtggcatgatctcagctcactgcaacctctgccttctgggttcacgtgattctcctgcctcaggcctcccgagtagctgggattacaggtgccaccatgcctggttaattttttgtatttttagtagagacggggtttcatcatgttggccaggttggtctcgaactcctgacctcaggtgatccacccgcctcagtctaccaaagtgcagggatcacaggcatgagcttccgcgctcagcctatttgaagatttaataacatttttcaaacctcaggatgtatttgagtagattgcttctaaattggtcacctagaaaataagttatctatttactatgatacctggattaagcctctagctattttgcttttttctttctatccatattattggatgattgatgcctattttctgtggttatgaatatagacattttaaatgaaagttggtatataaatttttgaaaataattgtatttcctgttttatagtcttaggattaatatatgggatttatcttatgttaatcttacatttaggattttgtgaaaatggaaaattatgaggcattggtaggctttgatctctgtaatacaccgctctccagtgttgctcagaagattatgtctgctatgcattcaggtgatttagtggattctaagacttggggaaagagtacagagagtaagtaatttttatgaacctttctttctcttgatactttgaatgttaattgttctaaagactaagaattgaaaatggaatgcatgtagacagatgaagcccagctcccgccccttttacactcattcagtgcagactgagcttctgcttgctaactttcgtgttcccttaaccttcattgctttaaaaatgtaacactctcttccttattccaggtatttctgtcaaacattcccttagaatctggatcaggtattttagtattttcaaaagagatgctttaatcttggttctcaggtcatcaaacctgtacatagtatttgctattttgtgtggtgaacaagagatatgtttttgacaatatgtgtattgtgctgctatagaaatgtaaactcttaggtggcaaggattattggatcagtgtatatggatttatgatgtggtataatagtaaaagcagtggggccgggtgcggtggctcacgcctgtaatcccagcactttgggaggccgaggtcggcgatcatgaggtcaggagatcgagaccatcctggctaacacggtaaaacactgtctctactaaaaatacaaaaaattagctgggagtggtggtaggcgcctgtagtccagctacttgggaggctgaggcaggagaatggcatgaacccaggaggcggggcttgcagtgagctgaggtctccagcgtgggcgacagagtgagactctatctctaaaaaaaaaaaaaaaaaaa

SEQ ID NO: 24 - DNA, 6195 bp, Homo sapiens
gtaaacagcgcagggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttatcttttgtatctttttcttatccaattgcaggtttgttttattatgcaataatggacataaaagcatgctttttgttcaggaattttaggaaccccatttgctttttttgaggcacactttagcagaaatgattgacctaggcctgttgcattaaaagcttacttctatttctaacataagatacacagagttatgttaataatttggttaagtatttatacacctgataacattttgagtctactctgatcacagaatcgtttatttaggttttctatttgttgttttagtcttctgtaagtgaacgactttgtacatgctttctactttacttcataaatggacttttaaccctcttgtattagttctgtattttaagttaactgtccagttctcccagtggtaaccaactataacatagaaatagagccgctcaagaaaacagtttatgaaataatttttttgaattttttcttgagttacacctggagttttggcctttggaatttggcctttataaacattaggaatatttgaatgtttgatttttttatagtatcaacagttgtactgtgtaccagatcacatagtacagttttacatttaatctatattggcctgaaaagaacaacacaggcactttactcttaaaggatataataaactatagttatactgcattcatattcataccagcatgtagtatctttccctgcattcacagaagttttatttacaatgacaaaactaaagcctgaggatttgttttaaatctgcattgtggtagagaggaaaaagtacttttaaggaaacctgggttctagttttgtcattgtctttaattaaaccggttagtgatacatggtaagtcacttcattggcattttgtgtattcatcagtaagctagacaagatgatagctacagtttaagaatttctgtaaccattatacaaaactggtaggtaatattaaaggtattttcctgaaataataggaataaatactgagcactttgtatgcaatagagactttgtgcttttatatacagactcatttaaatgggctcagagaggctagtaaacttgcccaagattagaaaggtagtaattgatgggccaagattttacccatgtttttatttggtgtttctaaaccacctcatcacttttgaaaaaacagtatataaattaataaatgttttggagatggagtctgtcgcccaggtggagggcagtggcatgatcttggctcactgcaacctcctgcctcagcctcccgaatggctgggactacaggcacccaccaccacaccccgctaatttttgtaattttagtagagatggggttccaacatgttggccaggctggtctcaaactcgacctcaagtgacctcacctgcctcagcctcctaaagtgttgggattacaggcgtgagccactgcacctggcctgagatttttaaacattaacatttccttcaggcttaagcagaggatttttctaaagtgccatccaattagatgttaagttatgctttgtatgttgagcttagtattgagtcgatctattttaaaaagccaacattaagtttttaccaagtatctggcactattctaaacaattctgttggctcacataatcatcactgttttctcctttcctaatttttaaaataaacttaccggaacattgtataaaaaatgcaagatttttttctgtacagaagagtcagtatataaaaatcagtatgttttatttaatattcgtacacatgacagcttttgtcactgtgagaagacatggtttctttcgtgtactccactgtgctgtgattctaacaatctacattagtatgatgtgttcagatgaaaaacagaaaattcagtcattccgagtttagaaatccggtcagggattttattggctggagtaatagttcaaaggagtgaaaattcaagcatgtaatttttggatttgatttcctccataatgatttcctccataatggctttttttcaagcatggtctaatttttcagaaaatggccattatctccaagcttccattgtccatgtagtttcagtggcaggagagagactattttcctcccagtgtccatgtcagttccccaaaaggactgaatagccatgttggttttggagccagccgtaatccaatctgtatttccaaggaaatggggttctttgtctcccagcattgggaagcaagagaggcacatgttatggtcacctctgtgaggattacatcaggaaggacagtctccaaaagacatggacagaggaaatttagcagatgtccattaaatcaggatctcatacaagttataacacctgaatgtttgacttttcagagtattttgccatcacaggtgtggcatcttgcccttggatatatctacattctgctgtagaatgtcgtggtctttctgagggtcacatacatcctgtcttgtcataatgttaaccattaagagtcctcaggggcatggaattgaagaaggaactgttgccagcagttaactgaccaagctagagttccctgacccaacgtaagggtgactgtgacacacatggataattttagcttcatgtttaagattttgttatttgggtaggaaacattccaaatgcagtttgaaacacatattaaaattgaggcacacaggaaagaactggctcaagtttagtccccaagttccttatagtaggaataggaatccttagagtataagcaatccatgcatagtattctgttatctatcatgtagatcatttaatctctaattttttggggtggggattctcttgtttctaaatcttacactttcagtttcttctgtgtcttaaatatagattattgactattgtcttaaatactaataaatacattaaatgtatcttaaatacta

SEQ ID NO: 25 - DNA, 2793 bp, Homo sapiens
atgacaacccacatctcaggaccggcaaggcgcaaacggggcagcctggagagcgccgtgggcgaggaaggcccccagcgcaggcttcggctattggtgttggtgccgcggccactggcccagccgatgggtcgggacacacgctcgcgctcgcggtccgcgggtcgccggggccgaaggcggcagagtcagagcgggagccgaagtcggagcaggagccatgggcggcgaaaccgacggcgccgggaggacgagggacggcgcagacggaggcggcggagccgggagcgcaggtcagattcagaggaagagcggtggcagcgctcagggatgcgaagccggagccccccgcggcccaagtggcactcaagagatgggtcctctcagtcggactcaggagaggagcagtcacggggccagtgggctcgccggcgacggcgcgcacgctcgtggtctcctagctcctcagcatccagctccgcgtctccagggcgatcccagagcccccgggcggccgcggctgccctgagccagcagcagagcctgcaggagcggctgcggctgcgggaggagcggaagcagcaggaggagctgatgaaggccttcgagacgcccgaggagaagcgcgcacggcggctggccaagaaggaggccaaggagcgcaagaagcgggagaagatgggctggggtgaggagtacatgggctacaccaacaccgacaaccccttcggagacaacaacctgctgggcaccttcatctggaataaggccctggagaagaaggggatcagccacctggaggagaaggagctgaaggagcggaacaagaggatccaggaggacaaccggctggagctgcagaaggtgaagcagctgcggctggagcgggagcgggagaaggccatgcgcgagcaggagctggagatgctgcagcgcgagaaggaggcagagcacttcaagacatgggaggagcaggaggacaacttccacctccagcaggccaagctgcgttccaagatccgcatccgggacgggcgggccaagcccatcgacctgctggccaagtacatcagcgctgaggatgacgatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcggtgttcaaggggaagacatacaaccagctgcaggtcatcttccagggcatcgagggcaaaatccgcgctggtggccccaacctggacatgggctactgggagagcctcctgcagcagcttcgtgcccacatggcacgggcccggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcgaagagaccctctgtggacacccacactctgcagggactggcccccaactcaccccgtgctggctggtggggtccatttccccgcagcgggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaa

SEQ ID NO: 26 - DNA, 6432 bp, Homo sapiens
gagagccgtagtttcttccattctgttttggacatgcgcggggcgtaaggcgctttggccagagtggtttgatggttttgtgttagtcttcctgcagctgagcttccacaagacactttttccctttcagccacccaatatctcgcgagacttgctattctgcgccccctcccaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttatttcacttttattgcatgttttgttatctgaaatgtttaggacaatgttaacaataatgatgttagacatttttttttcttattttaatgggaatgtccatagttttaagtttgctgttgggagttagatagtctttatctgaaagacagtgtctctcttttagtttttaaagagtttgaattagaaatggctctggaactttaaacagtataccatttgggcatctattaaagcattcatataattgttctcatttgatgttttgatgaggtatattaatagattttcccacattaaatcatctttgcactcctggaatcaggtagattaatttttaaaagaaattttaaaggatttatagtttatttgcactttttgtagacttgaattatatggatttaaaagttgatctaatattaataaaggctcactttgttttcaaaatttgaagtaattcacatacttatagcctaaaaaaatcggcaggaattacaaaatttcaaaactggcacattgtaaactgcatatgcatttgccaggtagtggtgccacttgaaatggtgaacagacacactgttatcctttgtcagtatcctgtaaagcccaggattctttaccagcaccatacagcgattttggtgactattttaacattcacactgaggccaggggtggtgagtcatgcctgtaatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaataaaaaacgacatcaaagaaaaactacactacagtgactgcagacttaatgttggccaaccatgcatcctccctagaaatgcatttgaatttgatttactaatcttttatttaggaaatttacatttttacattagtgagattggtcttttgggctattgtacttttttttttttttttttgagatggagtcttgctctctcacccaggctggagtgcagtagtgcaatcttggcccactgcaacctctgcctcctgggctcgagtgattctctgcctcagccttccaagtagctgggactacaggcatgtgccaccgcacctggctaatttttgtgtttttagtagagatggggttttgctatgttggccaggctggtcttgaattcctgacctcaggtgatccacctacctcggcctcccaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaat

SEQ ID NO: 27 - DNA, 1562 bp, Homo sapiens
gaagcggaagtggtgtagtggtgccgacttcctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataaaaaaaaaaaaaaaa

SEQ ID NO: 28 - DNA, 5455 bp, Homo sapiens
gggagattcgggaccatggcacctgtgcacggcgacgactctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaagcagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaaaaaaaaaaaaaaaaa

SEQ ID NO: 29 - DNA, 537 bp, Homo sapiens
aacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgctttgtaaaaaaaaaaaaaaaaaa

SEQ ID NO: 30 - DNA, 2811 bp, Homo sapiens
ccatttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttaccttaaaaaaaaaaaaaa

SEQ ID NO: 31 - DNA, 1843 bp, Homo sapiens
gcggaatggggcgggacttccagtaggaggcggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatc

SEQ ID NO: 32 - DNA, 1134 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 33 - DNA, 1466 bp, Homo sapiens
ggccacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 34 - DNA, 1686 bp, Homo sapiens
gggagcggaagaaggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaaaaaaaaaaaaaaaaaa

SEQ ID NO: 35 - DNA, 1087 bp, Homo sapiens
cgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaaaaaaaaaaaaaaaaaa

SEQ ID NO: 36 - DNA, 3778 bp, Homo sapiens
ccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttatttt

SEQ ID NO: 37 - DNA, 2643 bp, Homo sapiens
gcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccga

SEQ ID NO: 38 - DNA, 1586 bp, Homo sapiens
agtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaa

SEQ ID NO: 39 - DNA, 2352 bp, Homo sapiens
aagaagccctagacgcgtaaataagacgccgaccggcgcggcgctagcctcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcacaaaaaaa

SEQ ID NO: 40 - DNA, 2192 bp, Homo sapiens
gcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacttccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagccacaaaaaaaaaaaaaaaaaaaaa

SEQ ID NO: 41 - DNA, 783 bp, Homo sapiens
cgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacaaaaaaaaaaaaa

SEQ ID NO: 42 - DNA, 893 bp, Homo sapiens
gcctgcgcgatgcaagacgggagaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggcaaaaaaaaaaaaaaaaaa

SEQ ID NO: 43 - DNA, 5097 bp, Homo sapiens
ggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatataggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattg

SEQ ID NO: 44 - DNA, 1435 bp, Homo sapiens
atccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcctggagaaaaaaaaaaaaaaaaaaaaaaaaaaaaaaaaaaaaaaaaaaaaaaaa

SEQ ID NO: 45 - DNA, 3231 bp, Homo sapiens
aaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaaca

SEQ ID NO: 46 - DNA, 5473 bp, Homo sapiens
ggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcaaaaaa

SEQ ID NO: 47 - DNA, 2253 bp, Homo sapiens
cgcgagcgccccgggaggggaccggggctgccgtccctccgcctcttcccccgcggggcgtagcgatggcccgggccagggccggggcgctgctggcgctttgggtgctcggggccgccgcgcatccgcagtgcctggacttcaggccgcccttccggccgacgcagccgctgcgcctctgcgcgcagtactcggacttcggctgctgcgatgaggggcgcgacgccgagctgacccgccgcttctgggccctggcgagccgcgtggacgccgccgagtgggccgcgtgcgccggctacgcgagggacctgctgtgccaggaatgctcgccgtatgcagcccacctctatgacgccgaggacccattcacgcccctgcgcacggtgcccgggctctgccaggattactgcctggacatgtggcataagtgccgggggctgttccgtcacctgtcaactgaccaggagctctgggcgctggagggcaaccttgccaggttctgccgctacctgtccctggatgacacggactactgcttcccttacctgctggtcaacaagaacctcaactcaaacctgggccacgtggtagccgatgccaagggctgcctgcagctgtgcctggaggaggtggccaacgggctgcgcaaccccgtggccatggtccatgccagggatggcacccaccgcttcttcgtggccgagcaggtggggctggtgtgggcctacctgcccgaccgctcgaggctggggaagcctttcctgaacatcagccgggtggtgctcacctcgccctgggagggtgacgagcgtggcttcctgggcattgccttccaccccagcttccagcacaaccgcaggctctacgtctactactcagtgggtatccgcagcagtgagtggatccgcatcagcgagttcagagtctccgaggatgacgagaacgccgtggaccacagctctgagaggataatcctggaggtcaaagaaccagcctcaaaccacaacgggggccagctgcttttcggggatgacgggtacctctacatcttcactggagatggcgggatggccggagacccctttgggacatttggaaatgcccaaaacaagtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcggcggcaactatggctggcgcgcgcgcgaagggttcgagtgctacgaccgcagcctgtgcgccaacacctctctcaatgacttgctgccgattttcgcctacccgcacacggttggcaagtcggtcacagggggctacgtgtaccggggctgcgagtaccccaacctgaacggcctctacatttttggggatttcatgagcgggcgtctgatgtccctccaagagaacccagggacaggccagtggcagtacagtgagatctgcatgggccacggccagacctgtgagttcccaggcctcatcaacaactactacccgtacatcatctccttcggggaggacgaggccggggagctgtacttcatgtcgacaggggagccgagtgccacagctccacgcggagttgtctacaaaataattgacgcatccagctgtaaggccagaagcgccatgcccggctatgtcccagctccttccgtgtgcagctcattgacgtctcagccgttcattttacagtggtggaaatgagcacaaagacacgaagtcatgggcctggggcccagggccagggtggggcccaggccactggctccagagccctgccctaaccccttggctgtgtgccttcacctcaccctcttcaagcaccttccccaacccacgttgccctccaggcctctgtccagcccttcctcagctctcatcactcagacttggtaatccctgggctacacgactgactctctcccagctgctctgggagtctcagggccaagcctgtatctcttcactctgcagaggccgcccaggtgctgggaatggcacggagcagagactcaggaacacttgatgaataaatgagtgatcagctttcaaaaaaaaaaaaaaa

SEQ ID NO: 48 - DNA, 8575 bp, Homo sapiens
agactggcgaaagtgatgagtctaaaaaagtagtccctccggttcctctgtttccccccatgtggcgtcaggaagcgaggcaccgggcgcactgcgccccgaattcctgcgcccgccgcgcgcggcgctccgtggaggggtacataaggcggagggggtgaggcgactgggcggagttctgtcgccgggatccttccgctgggctcagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttcgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaataataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggtgctataacgctgcttatattgcagttaaccatagagaggtggagccacttaaaatgggcctattaccaaaattctccctggcatcattacagttcttggggatacactgattttagaaattactgtcagtatcctcctaaaagaaggcttaaatagtttctaacaagatgactatcaggaagctatgtggcttggggagttgggaccctctgcctcatattctgggtaactggtataacatagtaattattaggattgtatcaagtgtatctaaagatcaaaagggaaaaaaggcacccttaattgtcaaagttagttctaggaaaaaatactagcagggatgacaaactacgttcactttacagttaccataaattcttacttgggcccacccatttccatctgttaaggtccataaggttactcaagtttcagtggcttcattgttacaagaaaggggggaagtgagaaactttaataggctgtgatttagaaccactgctgattaacctttggccagtatgggtcagggaaggtgaacatgaaacactgcacagtaggttgtatcaatgctataaaac

SEQ ID NO: 49 - DNA, 1401 bp, Homo sapiens
ggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaaaa

SEQ ID NO: 50 - DNA, 5154 bp, Homo sapiens
gaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccccccaccttttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgt

SEQ ID NO: 51 - DNA, 3279 bp, Homo sapiens
actgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagag

SEQ ID NO: 52 - DNA, 3509 bp, Homo sapiens
ggcgccctgaaacgttcggcgagccgactgcggctgcgcggggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaa

SEQ ID NO: 53 - DNA, 4144 bp, Homo sapiens
ggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagttaaaaaaaaaaaaaa

SEQ ID NO: 54 - DNA, 3316 bp, Homo sapiens
ggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggtgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaacgggtttggaaattagtcgtcttttttccccactcccagagctgctcaagtcattccaccggccccctcggcttgggacagggtagtgtaactcccgatcccagggcctagccctgacacaggtggcttcccgtatcccggtgggaaaacgccctgccaccagcgggcttgagctggcctgtgtccctccaccgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcagaaaaaaaaaaaaaaaaaaaaaaaa

SEQ ID NO: 55 - DNA, 1473 bp, Homo sapiens
attagcgcctgcgccgtctctaggccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagtgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaaaaaaa

SEQ ID NO: 56 - DNA, 3449 bp, Homo sapiens
tcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaag

SEQ ID NO: 57 - DNA, 2844 bp, Homo sapiens
gtttccggaggagtgtgtccgcgcaattgaacgactttatgtcacttcctatcggatcggcggaagttgcttccgagcgcgttgagctttggcgaagtgggttccggtggtggcagaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggctgtgtggtccacccttttggctcttccataaatagcttcgatgtccatggctgtgatcttgacctcttcttggatctgggtgacttggaagagccccagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggctggccctgcataactcccgtttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcagttccctgctagcccagttcttctcctgtgtatcttgttgggatcttcgtggctccctgctgtccctgcgggagggtcaggcactgcctgtggcagggggcctgccttctaatctctgggagggtctgcgccttggccccctgaatctccaggacccttttgacctgagtcacaatgtcgcagccaatgtgaccagccgggtggctgggcgcctacagaactgctgccgagcagcagccaattactgccgaagcctccagtaccagcgccgttcctcccggggtcgggactgggggctgctccctcttctgcagcccagctcccccagctccctgctctctgctacgccgatccctttaccccttgcacccttcacccagctcactgctgccctggtgcaggtattcagggaagcactggggtgccatatagaacaggcaaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcagggtggctggcgactgaggctcaggtcacccaggagctgaaaggactgagtggtggcgaagagaggccagaaactgagcccctgctgagctttgtggcgtctgtctccccggctgaccgaatgctcactgtgaccccgctccaggatccccaaggcctgttccctgatctccatcatttcttacaggttttcctccctcaagcaattcgacatctcaagtgaagacatggcccctgaagggcaataaagctgctagtttattaatacagtcaaaaaaaaaaaaaaaaaa

SEQ ID NO: 58 - DNA, 6589 bp, Homo sapiens
gctgaggagaaagcggcgcgcggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgtttaaaaaaaaaaaaagccaacatttgttgaaactgcataataaattatcatttgtttttagaaacattcaaagaattattttttgattttttttttttttgggacagagtcacccaggctggagtgcagtggcatgatcttggctcactgcaacctccgcctcctgggttcaagcgattctcctgcctcagcctcctgagtagctgggattacaggcatacgccaccacgcccagctaaattttttttgtatttttagtagaggcagggtttcactgtgttggtcaggctggtcttgaactcctgacctcgtgatccacccccccctcagcctcccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttttgagtttttcagtggaatttgttttaaaacgttttgaagatttcagaggccttcatatttctcttatccactttctgaacccataaagcctttgcagtctccttgagtagtttatatttagtaatttagttgtgtacctttttattttgaagtaatttttgatttgcagaagagttgcagagacggtacagggtttccatgtaccctcaccttcccccaagtcaatatcaaaacaaagaaataagcattgttgcattgctgttaactaaaccacaggcctattgagattgtcccttttttttttttttttttttttgagacagagtctcgctctgtcgcccaggctggagtgcagtggcgcgatctcggctcaccgcaagccccgcctcccggattcacgccattctcctgcctcagcctcctgagtagctgggactacaggcacctgctaccacacccggctaatttttttatatttttagtagagatggggtttcaccgtgttagccaggatggtcttgatctcctgacctcgtgatctgccctcctcggcctcccaaagtgctgggattacaggcgtgagcaaccgcgcccagccgagattgccccgtttttttcccactgtccaggaatcgatttaatttttacagttgtttactttctcacatttttactaagtccagaatatcatcaaactcacaaaaccactggtcaaaaaaacccaaatggccactaattaggcaatacagcacctgcctcaaatttgggttcatatagatttttttcctccctttttgtggagaacatagtcttgctgtgttgcccaggctagtcttgaactcctggactcaagcaatcctcccgcctctgcctccctaaattctgggattacaggcgtgagctgctgtgcccagctcatccagattcttgctggttctctttctcagcctaaatgtcttgtttgcgtggagaaattatcaaatgaagcaggagtgccaaacaagcctcataggctcttcaccctacaacatctatgttaggtagaaaagtatgtggatttttaaaaatcatctggtataaagagtttttaagaactatcttcatcatcttagtatcagattgtgcttgagaagttaggtacaatgtaatgtgattcattgctaaaaacaaaatgcctcccacaattgcagactcactcattttaccaaactatggaatttgtcaacaccttttcttgggaccaaggaagcaaagtcagtggataccgtgtcctgtagacatgtcacttgtgataaggcacggacaacatgaactggcaaaaacattggcatttggtcaaatgcttatgagctaaggatagaagggaaaaaatagttgtgtgaatgattttacctcttagttcttacgaaggatggttatcgggctggaaaaatgtttattggactgatgctttggagcctctcaatgaatgtaataaaaaaaatgtgtagtgagcacaaatgtatggatttgcagcacaatccaactttgaaaatgtgaaaataagtgagttagtgatatgtttggttggtgttaatttgagtcctaaataaaatcgagaactggtaaaagaaaaaaaaaaaaaa

SEQ ID NO: 59 - DNA, 2934 bp, Homo sapiens
aggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctgaggaaggggtgcgcagccccccagagggggcagagattcccggggctgagcctgagaagatgggtggtgctggcacagtctgctcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattac

SEQ ID NO: 60 - DNA, 2298 bp, Homo sapiens
gtagagagttcggggctcgctaccagcccctctcctgattggccttgtgccgcgcgctcgagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaaccagaaaaaaaaaaaaaaaaaaaa

SEQ ID NO: 61 - DNA, 12520 bp, Homo sapiens
gtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtcggcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttataatcaatttattaataaaatgatggaaagtgggtaaggcaaacaggcaaatttagggactgtgaatgaaatattgtagtatatggcattttgaattggtaaagtaattccaaaaattaaataagaatacacattgttcagttgctaagaaaaatgcattctaacagtacaaatgaagtccagagtcagatcttttctcaaaatacttggcatatcaacacattacacataaacaaataaaaaccagtcctgtccctcatgataatgggtttctaatgtgatgtattcttgcaatctgaaacaccttataaagctgtattttcctgattgatgttggaaaaagcattcccaaaatgtgaattattgtttttatgaatagttacagaggatgtgatgacaatatgccagataatctatgtaattctttattcctggatacaagcacatggtggactgttttctcacaaccgattaaaattggatttatttttgcatgagaattgtaagggagccacaaccatgagtagtaacataattaatatacagtgtcaatattttatatttaatgagacatttattctataatcagttcttatttataaagaggcgcaaatcaatttcaacctgtaattacctctgtgctttgtgactcaggcacaatctaaacccagcttaatgaatcaaagagatgtttcttggcaagatattttcattaaagttatttggaaagggcaattaactgcaaaagggacttttttttttttaactgacaagatactatctaaactaatagtttaaaataacattgcttttatgtcaaagcactttggtaacttggcctcacatgctgacagttttggctaaatattacaaatcttgatcccagaagagcaagagagaaagttttactaatatttgcttaaacatcctgtttaacaactttataacatccttcggaatttttaaggtaataatgtgagatataagtatgataaaaacaacttttaaatggtatttaatgcaaatacagaataacgatgtcaacattttcctcagccgtgtaacctgagattcatcatgggaatgagaaagtaaaggccctttgtaatggcatgtgaaccagacaatttagtagccagggttgtaaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgacttgtaagaggtagcactagtaagtaacagtgctcaaattcaactaggtctttcagctttttatacaatactgcctgttatcagaaagtatagtcttaaaatctgctatcaagcatctatcagaagcctgatgagaaatattcagatgatctaacgcagttcccaaacctgcattgtgggccgttttcattacaattacctaaggtgctttaaaaattttcttgggccctactcgttgtggttcagcagctgtgtaatggagcaaaaaggaatagtcactaaacagcgaaggaaagtggtggaattattaaaagacctagcacttacctgctgggatgagtctctaaccccacagaattgatttcaaacacaggatcttattcaagataaggataataacagctatcttcttgggttgtaaaaagtagcattagactgcattttaaacatttggtatgattttgaggacataaccgtaaacagctatttaatactattccaggtagtcaaaggccaatgtataaaagttaaaaatataggtcttgtcagctttttaagcgtctgtcccactgactaccatatctctacaagagaatagatgaggaattgaggttatgtgggaagtacgtgtaagtttacagtattaagaaatgtacaataaaatttgtttctatgtcagcgaatattcttgactcaaggagtttgaaagtgtaaactcaaaggtctttcacatgtaaagaggaacctctccattctgtacttgtatagtcattacctcatatagatttaattttattaaattaaattttacttattttgggtttaaaaaaacttgggctgtgaatctcagttttaagtcatgggcaaatttgataaaaattcctttctgtctacatgtaatactgaaaaaaatgttgataaggtaaagctatctccatttagattgatacccattaaatagcatagtgctcccattaaactagcgacaaattcatttaattgtgagatatctagtacttatgctccatcctgtttatagggattattgatgtgagatttggtcagatgctttgatgtgatcttcattcctctgtatagtgggaaaccatgagacgtgcttagtcttcataaatcgatgctgcctcctagtggccattgctttcttttctacctgtccacaaacttcaaaaaaatagattttggaattttgtcagggacacttatcaagccattaatacatgccaggcagtatgctcaaagctgtggataggccagggaacagtattcttgtgcttgtgaagcttctatctgtctgtatctacctcaaccaaatcatcttgactcagatttactgtcgaaggtcgtgttatttcatcagattctttcagtattctgggatataatttatgggttctggattcattcaaaacaactagaaacagtctttttaaaataaatataattcaagtcaattattttccccatctattttttttcttttaagattgctaagtctgtaggttgcataattctaaggataaaggcgaaataggacttcaccaggagaatttctttcattagttaacagtatgccatctcctacttactggcatcatctggggaatgaaggagctgagaattgttcttccagatacctttccgacctcttcttggttttggcattaagtttttttttaactcaatttttgtgttagttttttgttatgccttttcatttccttctttttttaatgtttctttttttttaagtcctttaatttttatttatttatttatttatttatttatttatttatttatttatttttgagacacttcttgctctttcgccaggctggagtgcagtggtgcaatcttggctcactacaacctccgcatcctgggttcaagcgattcccctgccttagcctcccgagtagctgggactacaggcacgcgccaccacacctggctaatttttttgttttagtagagacggggtttcaccatgttggccaggatggtcttgatctcctgacctcgtgatctgcccacttcggcgtcccaaagtgctggaattacaggcatgaaccaccacgcccagcctaagtccttttattttacagagtattacttgttagaaatggcacagatcaagcattgctacaactggtatcaaattcccatcaatgtccctacaaggatatgatacgctttctctcttctctttagggtaatgttcaattacactgcatatattttgctattatgtaggttttttttttttttccacatatactggctttacaaatgccatataattagtatggtaccaaattgttattacatttgaaatacgttaaaaagaatccaggagtcagggtgggtggggagacaactccagggacacaatacattgtgtcttgtattaaaaactagtgtgtgttggggtggggaacaggcaggaaactaatatgtttctgtttgatatatgaaaatatgcacaagctatcatgtttcatctcatatcaacaaaatgattataataaatcatactctagaaaactcattaactgatacaagttgccagaaaatgctgcactatggcttatttcacattttaaaataaatgccctgaaagtgatcacaatgatagttaaaagttaaattttttattttaaaatttaaatttttattttaaaaaatagctctctgaatctgacttggataagctttattttaattgtgattctgctaattacagagacacttcaattcacactcataggaggtatgatttttaaaaggaaattgttgattagggtcttgggctagtccagtgtagcatggcagtgaaaggcacagactctggagtcatacttagtttgcagagcttagcatattaatcttaccatgtcttagttgctatgaaaatgagtacctgcttccttgtactgtcaagattaagataagcagttagcactccctagaacatactaatttgtcaatattaatgatagctaacaattatcctgatattgaatgatggactccaaattatttattgtggcctaggaaaagtactaagaagtaattgatagcattccctgataattttggtgaaaagaaaaactatgaaaattctggacaggactggaaatttattgtaaatgaaagtatgcttccctggtgcaaaggtaatgtgatgtttttaatcacatattttaaaattaaaaatttgatcaaatttttaaaagtaacacgaggcagagaaagtacagaaaggagcaaccagagtcaaagtgattaagttataaaaaggttagatttctttggtgtgaaaagataaatgagaaatgagaatatgccagagatctgaaatgaagaatggataagagcttgcatatttaattttgtatattaaaaccaaatattctatgaagattggaaggataattttaggtcaaatgaaattctacattaaagaaagaagaataaaccttaacaactcattagtaatccttcatttcctgagtatttactgcatgacagtaacagagatgacatgcccggtaaactggtgtttgaaggcaatatataaaagcttcccatgcatggcaaagatgcattttcctctatgcatagcaatatgggagagattggaggagaatcttcatggaaatggatgacttgtgcttgaccctaaggatagtaaggatttccatagatggttaggaaaacttcaaattggcagacaggaaggcaagaaggagtaagatgtggttgagtaataaggagtagactgacctctctgtacagtaaaggctcaaatcctttttattgcaaagaaaggacctgtccttcaccagttcctggaagaaaatctcttgagtccttgggatgtcttacctgttaagagtgcttttgtatgcctgagaccataggccttgctgttacagtttaagctctgggaaacgagattcaggagctaaggtcagttatgagggaactgaatatttatgtgactgaaccctcataaaaaccctgaacaccaaggctcaagagagcttattagcaatactttgcatgtgttggtaaacaccgttgctgaactaggtgctgtctgtgcagctccactgggagaggacatcttgaagtttgtgcctggtttctcctgattttcaccctgcacaccttttccatttactgattttaatctatatcctctcactataatctgcaactgggagcatagcagcttttctgagtcctatgattccaagtgtatcaatgaacctcagtatgatcttggggacccccaactcactatctaaataaaattttcattgaaaattagtgagaagggaagagatggccttcaatactagtgcaaagttaatactttattcttagagcagcaagttgattttaggggattaaaaatctaagacgtttaagggaacatgaatttggatgcattgaacagaattggtaacctgaaggagaaactggaggcaaattgtttcaagttaggaagctattgcagtaattaaactgagctgacacattttcatgtcagattttcagatatgataaaggctggaagtacagagtttcaaaagatgtacataaatttatggaaaggaaattttggaatggtgattctaacctttaaggttggtgccatggaaggaaaacaagtaactttgcaacaatctgttcaacaatgagagttaccaaatgccagacactgctaagtgctgggaacttagatgtaaccaaagacttaaaagatactagtctttaagacaggctttgagaaattcaagtgtagggtaaggccacctccccagcaagtaaatactgacatggtgaagatatgtattgggtgatatgagagcccataggagagacatctaaagtttaatagcaacactaggctggactgagtggtgaatacgttgatatagcaatttaataaatgtgttattgtcaatgtaggcattttgctcatagcttagggcaagtgataaaaaacagagcttaacaaaggactggatgttttagtttgacagcagtgtctaaattacagattagagaactaatgactagccataccgaagacatttatctggaaatgccttccctaagtgccaacagagaatgaaaatatagtcaatagctttaagtgaccccatgcatcttaatgcctttcaagcaacatgtttttctgacttccaaatataaacaacctaagcattgtgcagtagccatgagggactaggtatccaagtgcacattatattggctttgtagagccattggagggagtaatagtttcagagtcatgaaacaaatcataagtagctgctctggtgctctctagaggcagaacttgctgaatttgaagactattaatgatgcagctctcactggtacaagtgaaaaacctctcagccctacacagcatctttaagaaagctttaattttggtttttcagagcaatattcacatgacatctttcggatctggaatcttaattaccattaggttggaactctacctgaactaaaaataagtggtctctatcacgttgaaattactttaatattttcatttatgtttatactatttatttaaatgcggagaacatggctaaccattcaggaccatttaattatcaaattattaatgattcttccataataaacaagcaaactgtcatacttgttgacttatatttcattccatggaattcaaatttaattaattgataaatcacattgtactttataagagtttattccttaagtgtttgaatttacacttttttctcctgtgacagcatctattcccaaggcaatcaacattttaatggaacgaactgaggtttgcaattgctaatgttattctcccatcccagtttctacttgtttcttgtaaaaaaggaggtttctaaatcttgactgttgattgacaattaatgggctaaatttcccattagcaaacacttttcacatatacactaatattagtatctaaattatattaaaatctaatttggtagcaattgacttgaaatttgtgatacttcaacttgtgctaggttgtagttttgcttgtatcactcatagttactaaaaatgcaaaaggcaaatttgaaataactataaaaataaacctttaatgaactttttaatatgcaatactcaattgtaaataaccattatctttactgaatcagatgtttcattaactgttagcagttatttcgagttatttatatatcacagaattttgaactaaagatcatctagctgaatttcctttatattaaagaagaggagaaaatcttaatactaagtatgtgtgagcctggagctgccatggagcatgtagagagagtctcctagttgataccaactcaggaaagcagaatcaagcaataaagagacattttgggcctgatgacatcatttcagcacctggatccagcgatgcctaaagatgtgactcctagacttttcacttacatgagccaaaacggttcctttgcatcaataaatcgctctgtgatgcattttataatgtacaaccaagaatctcaatatttattattttgcattaaatatcagtaagtttgatataaaaagctcagtaaaattcattaatttgagaatgtgtctatatcatagtaaagttttaaacctacataattttcaatatttataccttttactgcaaaaataaaaatgagtttatccttgccctaaagctgtaaaattaaactctgtacaattctagttatttgaaatataaaataaaattattggtcatttcatgtatacatttgtggtaacactttaactttttccctgtaaggccatcttttgtatgtttctgtttccatcaagcaggcttttaatgcaactttatcttctgggtttccctagtcataattaagggtttggccctagttcacaagtaatcttccagcacaaattttataaacaaatgccctgtgaatctgcatggcataaatcaagtctctagatcctgatcacttctatgtgaatttgtaatattctgcttttggacttgtaagaccaagagcagactccctaaacacagaggaggcagtaatttaggacagcttaaacattctggctgactgcctcatcaatgctatttaataacagaattctggggatgtcttgaaatagatacattggcagtttttttgtttttgtttttgcttgtgtcacacataatgctgatgaagaaaccatgaagtgtcatatgaaaggaagttacgattattattggtgagtacatcagttagaatggtatttggctataagcactggaaactctgactgccagtggctttaacaggcaggaggagttcatttatctcgagagaaaagaacagaaaagtgaaaagcaaggcagttcagactggggcacctactcaaagaagtgacccagtacccaggccactattttctctttgccatccttttgttctaataatttgcctgtcatctcgtgactcatattttccatctaattagaataaagaaagatgaaataggaaagtgagattatcatatgggaaaaataaatgctttcccaactataaccagcagactatactggcaaaatatactgcttgaatgccattggccagatctttgtcatatggttaccctaactacaagggaggctaggaaggtgagggatttttttccttttatagtgacattttgccactccaaataaaaaaagggttgctgttaggaaaaagagaagaatggggatggggtgaacaaccaacaatgctgccattgtgctagtatagaagcaagtatctcagaggcaggtgaaaacaacttctatgcccaaacagaattcttttttatctctgatataaaatgcagaatatgaattttaataaattccccaggtgagtcatatgcacattaaagtttgagaagcactgatctatactgtctttctacacacttttttaccttactttatccttcaggattctggcgtcaagtccctccctatcagtctttaaaaactgtagccttaaatcagtagggatatagaagacatgaacaatactttcatccatcttgacctaactgccatttatagaacgttctatcccaagacatcagaatatatattctttttaaacatttaatgaaaggatttaactcccaaactccaaagcaagatgttctaagaagactcatttaaaaaattaatctcaaaaaacagattttaaattgtacaggagaaatgcttatatgagaacagaattatggggcactctgaatactaatttaagaaagaaatataaaccccttttaaaactcacataattttcccatttcccttgaagaagatactaatatttctgatatcatataggagtaaaaattgcggggaggtcctaatatccaatattaatagagctgtgattattcaagctgtagacttaaattttttaaatagagtaatggttgtttagtagagattaatatctaaataaggaaaatgaagaaagggactaaaaatcaagtaaataggataattgagtttcaatgggcaagaatttttatatcatgattttaccactctgaatatcaaagtcagtgatgtctccaaaaggcaaagggaagtgtaccaatttttggagcactataaaaagtgaaaagtcatctgccagatctaacatggtatactctaatggaaaaatcatcaagattctcttcctttttatgattctatagtaacagtttagttgagaaaataaatcataatttgtgatttcaaacatttaatatgtgcacatgtatattataatatactcatcctttatatttatcatgcttttttgaataaatttgccaccttattgcatatgaagaatatctccatattcttacagctgtttttcttggttgctttctaattcctttcctcccttattggttacctatgaattgctcagttctaacaatgatttgtaaattttaatactatagatatattgctgttaattattacacctaaaaataaattattttacagaggctactaa

SEQ ID NO: 62 - DNA, 2894 bp, Homo sapiens
actagaggtggggttagcgcttggaagcaccgaccaacgtgagcgcaacgcggcagggacacctgaccccggcggcgcccagcccctcggattgccagtcactgctcgctttggggcacggaggtgcccagtcctgcggggcacccgacgtcctgtcgccgacagggtccgggagtcagtatagctgggttctagtcccatcacaggcaaaaactccgcgggagcctggcccgctttttacctgggcctcagtttccccatccgtaaaatagaacgggttggatctcccgagcgctaacattccagaactcggatggggcgaaggggagggagggatgggccacccacacgtgacctccccgcgtggagccccgcctaccactgatccagggggtggcagctccggccgggacgagcggggtgggcgggtcctaggaaaccctacccggccgcccttggcagcgcctaaggcggagcgcgcggctctgcagcctgcttgccccggagttggcacccacggaggatggggaccgcaccctcagcttcgcagggagccaccgtggaggccagggcggtgcagagacacgacgtgtgactcggagtgcgcctggggaggatggacgagggagcgggggaccgctaacggggctccctctgcgcgccccgtccgcagaggcgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggctctgggtggccttctcgggctgcctggacctgctggaagcggacatgcgacgcgcgctggagctgggcgccgcgttcccgctgcacgcgccgcggcggccgctggtgcgcacaggtgtggctggcgcctcctccggcgtggcggcgcgcgcgctgagcacccgcagcctgcggctcgaggcggagggcgacttcgacgtcgcggacctgcgggagctggagcgcgaggtccttcaggtgggcgagatgatcgacaacatggagatgaaggtcaacgtgccccgctggaccgtgcaagcccggcaggcggcgggcgccgagctcctgtccacggtcagcgccggcccctcctcggtcgtgtccttgcaggagcgcggggggggttgcgaccccaggaaggccctggccgccatccttttcggcgccgtgctgctggcggctgtggccctagccgtgtgcgtggcgaagctgagctgacggacacccgacggccgcctgctgctgccgctccctcccctgagaaaagactcgggatgggtgtggggtctggcctgtgcaaggggagtggtcctaaaaccccgtgtgtgcatgggtacacgcgcgtttccagtgcacatctgcctgggcaggacacggtttcctcttgctggcccgggaggagttaactttgcgccggccgtcagggcattaccgctaacgtctgcaggagctttattccctattaatagaaaaccgtcacagtgaccctagatccctccgagttaatgagttaacacatgtgctgttggggcgtctttacagggagtccgagttcggtgcccacccctgccagcgtcgccccctttctgcgtgggacagtttgaaaaggtgggtggggtggagtgaagtttggagagggacgctgtttggttctatgtggttggtctgtttcccggacaagaaaaattgcaatcaaatgtcagcagcttttattaccttaatctttcagggcctaaatttaggagagtgtcccgagagcagttcatacaaagggctttctctaagacgcgctacagcccttcctagcagagtttatccattcgtccccaagagcagctagaagagatttgaggtcatgacctcccactgccgctcaggggctgaccctatttaggaaaccaaagagggtgggttgaacctactctcacggacttggatccagtgcgcacacttgcctgcggaaaagggctctccccagccacccggagatgggggtaagaggaagagcagaggcttggggtagggccacctggtgtttaaacaggcactttctccttctctggggcttatttttgttcagaactagaccagagtgtttgaacctcctttgcaggagggctgggaatcctctttagagcacttaatcctatttatcccctggaatgtgcgtgctggccagtaggagggctggctttggcagctccctgacccccgcgctgcccgcccctccggggtaatgtggcattactggcccacagaggttttgagccaatcagctctgagactgggttagaatgtaacagctttaacttgggatttaagaagcttttaaaaggtaataatactctgaaagaaaaatgacgtaaccacagcgtgtactatgaaagctgttattttaataaagaacgctgggccatgaactcatacctgccaatgagtcaaacatagtatctttatgtagatacttagattactaaatatatatttcatctacttctgaagttgatagtcttcccccccccccacttttttcttttttgagacagg

SEQ ID NO: 63 - DNA, 4173 bp, Homo sapiens
gaggcctgcgcgtgcggtctgcagttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaagaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggtgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtgcagtggtgcagtctgtagctcactgcagcctcaaactcctaggctcaggcgatcctcttgccctggcctcccatgtagctgcaactataggtgtgtgccactacacctggctaatgtttttagttttttagagatggagtcttgctctgttgcctaggctggtcttgaactcctgggctcagatgatcctcctgtcctcagcctcccaaaatgctgggagccaccaggcaccaggtgtgatctaccacacctgtctaaaaagtatgtatttttaaatttttttgtagagacaggatctcactatgttctccagctggtctcaagctcctggcctcggcctcctaaagtgctgggattacaagtgtgagccactgtgcctagtcactttaattgagatattggcaagtcaactgccatgcagagcccagggcactggttatattcagtaggaaactgaactcagcactcagaattttaaattaaatcaatgatcttcaagtatttgccactttcgagtacagctaattggataatctcaaaccctttagtgaaaatatcttaaatgcattgagaatattttctaattacctgtgtatgctacagtacagacattaattctataaacatgttcataggtcttccccctcgccccgcccgtcttctaagggcattttctgtttctttttagtgagttcatgaatgtttaacggttctggcgcaaagctttcttgcattctgagcataaaaataataaaacccacttatatttgcttgagtgtgtttacaagtcaatttccttttatgtagcttgctttttcatttgctataattgatcctgcaggtgtgtgaattattaaactaacgctcttttaaaccaca

SEQ ID NO: 64 - DNA, 3490 bp, Homo sapiens
cacgtcagccaaggactctggagccgccgccgccgctgctgcggttcatagccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccggattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatgg

SEQ ID NO: 65 - DNA, 2427 bp, Homo sapiens
acttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtcaaaaaaa

SEQ ID NO: 66 - DNA, 2679 bp, Homo sapiens
gggtggaagtgacgctgcccccgctgcccaaaatgtcggcgcccagagggaggtagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacgcacgacctgcagggcccgggcgcgcccccagcgcaggcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccttggaggagcaccggcgggtcagccacggtgagggcggcggggaggaggcggcgaccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaagctgcaccggggcatggactgactgccaggctgcgtgcgccctgccctccacccagcctcctggactcggcctggaccaggggacctcgggactgcgcgtgaggccccggccctccaaatccaaatccagacgcaggccctgaaatgaggggaccctgactggagaggtgggggccaccaaaaacccacaaaggccccggagctgggggaccacaaacaaacagggtccttagctggggcaggggagcccaaatctagggagagactcctgagcctgaggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgaaaaaaaaaaaaaaaaaaaa

SEQ ID NO: 67 - DNA, 2246 bp, Homo sapiens
agacacacccaggcagcccaccctgcccaggacctggggatgcggggcgggagagcgcggccggcgtgggagagctttatggggctgccccctcgatcgtctgcgaagtggggcgcggggcagtccctggaccggctctgctgtgctccgggcagtcgggggcttgcgggcgctccggggaggatgcgggcaccaccggctggacggtcgcagcctgcagggggccctggggacagcctgcctcatccccccggcgggctcgggccaggtggcagcgcctgggctcgccgcgcggaggcggcggcttctcgggctaggggcggcggcaggggcggccccgggatcacatgggcggaggcaggtccgggagccccgggcgggctctccccagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaaaaaaaaaaaa

SEQ ID NO: 68 - DNA, 2733 bp, Homo sapiens
tcatggctgcgcgtgcagacgtgcgtcatcgccgcgcgccgcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaaaaaaaaaaaaaaaaaaaaaaaaa

SEQ ID NO: 69 - DNA, 2728 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgcaaaaaaaaaaaaaaaaaa

SEQ ID NO: 70 - DNA, 2472 bp, Homo sapiens
ttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgagttgctccgttgctgcccccctttttccttttctaggttgacctctccttgcccctaagcatggtaataacagttgcatgtattgagtgcttaccaaatggcaagcattgtgctgattcccatgcctacacgatctcatttcttccttaccacatccctgtaagtaaggtgaaatgccagagacctagacggggtggaaggagcaagtgactgctgggatttgcaccaggtctgcctaactcccagatcactatgatttgccctggtgttgcattggcctggtattcttggttctcctttctaaccctcagttcttggaggacaagatacctggtgatttaaaatattattttagtcttgggaaactaatttcaatttattagtttttcattattctaagacttcttcctttgtataaacttacttgcagatggttgaaagatagcttgaatttaatgaaatagaattcagtgtgccaggagttaggttcataccaggtggggatttcagtttcagcaagttggcatcatttttatagggtaggacagttctttgttacagagacataacgatactgtactctccacattattttaaatattagttgcctttgtaaacagtttcccctcccccacccctttttcgataattttagtaggtacaaaaaggttgatagtaacctgtatttatttcaaagatgctaatttgtatgtgaattgattatgtatgtagtagctttttaccttttagaacttaagacattagatgtgtggctatgtcaacaataataatcaaagctaacacattttgagctagacagtattctaggccctttatgattgttgagcattaatcctcaaaatgaccctgtaaaatagttaatattatccccatttgacagacgaaaaaatagaggcacagtgaagtaacttgcctaagaccacacaggagtaagtagcagtgctggtatttgaaccaggcatcctggctccagagcccattcttttaatcagagagacagagaataatgctggactacctgggtaaaatttgccacacacccagcctgaagttctaaaagaaaaagctaaaaaatatggttaaaaactgtatatacaacacagtttaatctctctgcttcatatttcacatctgaaaagtggcgttggaaataatacctctttcactaggtgagaattaaatgacttaatgtgtattaaagggcttacatgggtattagctaatgcagtagtatgattgttttattagcatatgcattatccatatagctttggtttatattttccatagagcctaaactttatagatcactatctaaatgaaaatttacatcaaactagtgttttaatatgacagttctagtgttgtttaagtctaagtgaagatttagggcatcttcctgggttttgggatttgtgcagtgtggcttctgaccagctgcatagacatggctccaggtaacagtccctgggactgagcagtggcccatgttggctgttggagctttcttttccctcatttgttatgagtcaataaagaagcagaaggtttggacgtgctagccagtgggaaagggaacctgagatggagctctctgatcaccctttcagccccagggcccggctctgtgtgagaagtctgtcccaaaattctgggacggaccacctcactgaccagctgaccagctgaccaggtctgtgtgttgcaggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacaaaaaaaaaaaaaaaaaaaaaaaaaaaaaaaaaaaaa

SEQ ID NO: 71 - DNA, 1610 bp, Homo sapiens
tcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcaaaaaaaaaaaaaaaaaaaaaaaaaaaaaaa

SEQ ID NO: 72 - DNA, 978 bp, Homo sapiens
agtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtgaaaaaaaaaaaaaaaa

SEQ ID NO: 73 - DNA, 1215 bp, Homo sapiens
tggcgcttcctcttccgggtcggcgctcctgcctccctgcagggagctgcttatgggacaccaattcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccacacccgagagggtgccttgagcatggcccgtgccaccttggcccagcgctcatacctcccacaaatctcctagtctaataaaaccttccatctcatactgaccca

SEQ ID NO: 74 - DNA, 3082 bp, Homo sapiens
agtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaacataatgtctgtgtcatcaagtattatagtcagacttttctttttttctagattgttaaaattggcaaatgaacttttttaaaaatcatcttccatgttgcagttagtctttcttttcattacaagtctttcacagaagtttggtggtaatattgaaagaactagcattgggcagaatgtgtcttttttaggcactttatattctcaacatacaatgttaagaaccatcaattttgacttttactaagttgttaaataaagttataatacagctgtgaaaaaaaaaa

SEQ ID NO: 75 - DNA, 4503 bp, Homo sapiens
atggtggcggtgggggaggaaggcggttcttgtaatgatccgagaggagaccgcagcaccggttacgccctcgaacctcggcctcctcatctgcagaatggacgcagtccacaccgcgtgctgtggaagggttggagcgccggtttacatgacacagggctatcggctaagggggcgctgggaacgtggaaggccggccacgtgacgcccgcggcccggcggggctgccaggcggcgagcgccgcggcggccccgggaggtggcggcgggcgcgagagcctgggccgcgcgggactgaccgtcggggccccgggacggcggccccggggcgcccatgccatggagaagctggcggccgggctggccggcctgcgctggagcatgggcgccttcccgctcgacctcatcgtcagccgctgccgcctgcccacgctcgcctgccttgggccaggggagtacgccgagggcgtcagtgagcgagacatcctgctcatccactcctgccggcagtggacaacggtgacagctcataccctggaggagggccactatgtcatcgggcccaagatcgacatccccctgcagtacccagggaagttcaagctcctggaacaggcccgggatgtgcgggagccagtgaggtacttcagcagcgtggaggaggtggccagtgtcttccctgaccgcatcttcgtgatggaagccatcaccttcagcgtcaaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcccctacgaggagttgtgggcgcaccaggggcccgagggcctcgtccggccgcccccagggctcgatctcatctccttcggggccgcgggaccgccgcgtcgggagccggaagcgccgccgcctccagtccctcccaaatccgaggcggtgaaggaggagtgccgcctgctcaatgcccctccagtgcctccccggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggtgggcgagtcctctagccgcccagcccccggtcccctaccctcaaccacacagcccagccaggcctcccgggccctcacagagcctctgagcggtcgagccgcctcccttctgggggctgacacccctgttaagacctaccacagctgccctcctctattcaagccctcacatccccagaagcgctttgctccgtttggagctctcaaccctttttccgggcctgcctacccctcaggcccttcagcggccttgtcttctgggcccagaaccacctcgggtcctgtggctacctctggccctgcgtattccccaggcccagcctcgccaggccaggcctattcagctgctcccccctcctcctgcgccccctcctcctcctcttcttctgaatggcaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctgaagatgagtacaagtggcattctgggtgccagctgctttcttcttttgaaaacaaggccatggggacccatgggcacagtgtatatgccttctggcaggagaggactgatggaggaatgatgtgggtgtgtggccattcccatgtctgtgga

SEQ ID NO: 76 - DNA, 625 bp, Homo sapiens
agtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaatctttc

SEQ ID NO: 77 - DNA, 6098 bp, Homo sapiens
agatctcgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctcccggattcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccacgcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccaccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctggagcctccgaattctccgttttctgaattgcataggcacgataggggtcgggtctgtcctttgttggagtcagtccccccttttcttagcaagtcagtgtgttttagaagggaggtggcagcattgagggaaaccaggtcaccatccaccctcgtaacaacagtctccctgggtgggtcccagaagtgatctttgtgtcgctcgggtcggaactctttaggcctctggcctccaccctcccccaacagcagggatgggtcaggtggcagcatccaaaaccacggtgaagatactagggtccagaggccgactggagcaaggtttgctggcagatgaggcctcagtggaagtgacggctactgtggagatgcagtggaggacctggtggctgagccaggagatgcacaccttcgcttctctcaccaggaacattcgcttctctcaccaggaacatttatggtagtatgaggggttggaacattattactcaacccatttcaggtcctttcacattcttgagctgccatgttgtgcttttgtagagagatgattattgtactgtgggaggtcaggaagttcgagattccttcactgtcagaatgggctcaaggagccatcttttgtgataggtattggggaactaaggggtatctctgctacaggaatgggagtgagaacattcactttttgaaggacaagtatatgtgggtctatgatgatgtttttgtaaaacccttttgtgtatgtgtctgtgtgagtcctaatattcagtaagtattttcctctgtgtaactccctctaataggtgtagtcaacaaagctgtgctaatatctctgtccccttgatcctggcattctggaagacacgaaagcaagcaaggatatataaggcactgtggtggttattcccgaggagccagagaaacctggagaagagatcagaacacctggggtccttctatttgggagaatcttttagtatctgggctgttacacctgtgggtttgtgaatttgtgtctgtccacctgtatgtacagtgataacgtgtgtgatttttgtatatttgtctagagggctgtgtgtatatatatttatatatatttttaaatatggaatgcttttaggtttttttttttttttttttttttgagatggattctcactgttgccaggctggagtgcagtggcacaatcttggctcactgcaacctccacttctcaggttcaagcaattctcctgcctcagcctcctgagtagctgggactataggcgcgtgccaccacaaccagctaaatttttttgtatttttagtagagatggggtttcaccatgttgaccaggatggtctcaatctcctgaccttgtgatccacccacctcggtctccccaaagtgctgggattacaggcgtgagccactctgcctggctggttattttgtttgtttgttgtttttttgagacacagtctcgctctgtcaccaagctggactgcagtggcatgatctcggctcactgcaatctctgcctcccaggttcaagcaattctcctgtttcagcctcctgagtagctgggattacaggcgcgtgccaccataccgagctagtttttttatttttagtagagacggggtttcaccatgttggccaggatggtctcgccctcctgaccttgtgatctgcctgcctcggcctctcaaagtgctgggattagaggcttgagccaccaggcccggctggaatgcttgcattttcttgcctgatttccctgggagcaccccccttaacactgaatggagctggtgagagcaaatatccttgtttctgatattagatattaaaaatatggtttttcacc

SEQ ID NO: 78 - DNA, 1939 bp, Homo sapiens
cgcctccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaaaaaaaaaaaaaaaaaaaa

SEQ ID NO: 79 - DNA, 2995 bp, Homo sapiens
ccctagccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtaaaaaaaaaaaaaaaaaa

SEQ ID NO: 80 - DNA, 3128 bp, Homo sapiens
gcttcgccccgtggcgcggtttgaaattttgcggggctcaacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaagaaaaaaaaaaaaaaaa

SEQ ID NO: 81 - DNA, 4187 bp, Homo sapiens
ataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctgccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccaaaaaaaaaaaaaaaa

SEQ ID NO: 82 - DNA, 2119 bp, Homo sapiens
atttcctctgggttacggcgcaggcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacccccttcccctctgcttatctgcaatgtcaccacctgttgcttccccgttaccgccatgctgcgtggagcatgcacctattccagtggccctgtgactgtcagctccttaagaagcaccaggggcccttagcccctttggatcccccacatccttccctccatctccctgttccccagagcaaaggctgctgcaggggagacacctcagctgccttccaagcagacagacaagtctttgtgcccagggagctggttgccacggaaacccccaatttcctttccagtggggactggctgcaggggcttctcccttctcaggagtatcacagagcaggtctcatcaagccacccattgtttcctaaggacctgcttcgagcctcttatcgtgggctcggatcccctttcaggagcagtgccccagcaggaagcgtgggggtgtgctgatctcccaccctccccaggcagagccctgctgggcaagtcagcagctggagcaaggaccgagcacctgcctacccctgcccccatggctctgtccccactcctcctcaggactctgcccacacgctgtcctctgtggcccacctctttggtgtgccacacccatgccttcttcctagcctctataagatatcctttccctcctatttggggctggtgatcccctgaggccttggggacatggtgctggggtggtggtgctcctgggttccaggtgttacattaagtcagagctggagttcccccttcctctgcctgaggttctaatgggtcctcttcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacactcccatccaccctcctccaagcctgtggaatcctttaatcaagttgggtgctgaaatttcagctctgaaatgccgcctttgtgctggcatccaggcagccgccccagagtgcgggggtcactttctcggccccatttctctaaatggtctctttgttccctgctgggctgctcagtatcagatgtgattaaagggagatggggtttgggctggggaggaggggaattgggggttaacccttaggggatagagtgcaagggaaatgggacagaaggggtgtttttcctcctgtcttcctcttcccattctcctcttttggggagtcccctgctattcagctgtctgggcctggcttttgacttctcttgaataaaatgtcccggtcaccaaaaaaaaaaaaaaaaaa

SEQ ID NO: 83 - DNA, 4014 bp, Homo sapiens
tggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggaaaaaaaaaaaaaaaaaaaaaa

SEQ ID NO: 84 - DNA, 3167 bp, Homo sapiens
aggggcgttgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcagtgtgtagagtggaaaaaaaaaaaaaaaaaaaaaaaaaaaaaaaaaaaaaaa

SEQ ID NO: 85 - DNA, 1985 bp, Homo sapiens
gcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtgatggagcggcaaaaa

SEQ ID NO: 86 - DNA, 2840 bp, Homo sapiens
agtgaacgtgctccgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtggcctttggtgttctggagtagggggagggaaggagaaacatgttttccacatcatcgcaagtgtgtgccctttgccccttttcaggatccttagagttgcctccctccctccaccccgacagttttgcaataatgtgccttatcagttgtgagtttacaggtgaagcaatttcccaaataaatggatgtaagtgttcaaaaaaaaaaaaa

SEQ ID NO: 87 - DNA, 911 bp, Homo sapiens
cccggccccgagggcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccagtggc

SEQ ID NO: 88 - DNA, 3644 bp, Homo sapiens
cttttcctcctcagctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtaaaaaaaaaaaaaaaaaaaaaaaaaaaaaaa

SEQ ID NO: 89 - DNA, 2399 bp, Homo sapiens
agtctaaagcctggctcccttccggcctggcgcgctacggttcccgcaggcgctccgcttcagcaccgcgggcgtggacagctccggggcgcgaggctctgggactcatctgcaggaagtgaacctggcaggaggcttgcttcaggtttttaggaaccatttttgcaattggagatgtttgtgaggaaaaaaatctctgttgaggggggtactgtgtgtctctgaagtggcctctgtgttgcgtctcaggcgtcctggtcctgtcctggtacccacctggcatggctgatgataacggggagccctcagatgacctggtgcccgccattctggacaccgcccatcagtacagcatccaggtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaagtaagcattccttttgctctctttaagacctcacagattctgaccttagattctgtgacaaactgatacaggagctgggctggctatggctttaccacaacaagtaggtttgcttaagaaattactaaacaatggctgggcgtggtggctcactcctgtaatcccagcactttgggaggccgagatgggcggatcacgaggtcaggagatcgagaccatcctggctaacagggtgaaaccacgtctctactaaaaatacaaaaaaattagccaggcgtagtggtgggcgcctgtagtcccagctacttgggaggctgaggcaggagaatggcgtgaacccgggaggcggagcttgcagtgagccgagatcacgccactgcactccagcctgggcgacagagcgagactccgtctcaaaaaaaaaaaagttactaaacaaggctgggcgtggtggctcacacctgtaatcccag

SEQ ID NO: 90 - DNA, 6670 bp, Homo sapiens
gtttcccggcatgcgccgcggaggaagagacggagtcgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaggtgagggtgcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttcaaaa

SEQ ID NO: 91 - DNA, 5112 bp, Homo sapiens
gactaaacggagtggcggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactatatcttaattgttaactgttaataattatctggcccagaaaaagagatgcagtgattttacccttcacaggaatattgaacttcttctgtaaaagagagagagaaacctctctctctcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagcagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgtttaatgcttacctgatggcaacttctggctctggaaccgctactctgccctgttcccagccacttcccaacctgattcaagcagggcccctccttcctcctgtctttatttatttatttattgagacagagtctcactctgtcgcccaggctggagtgcagtagcgcgatctcggctcactgcgagctctgcctcctgggttcaagcgattctcttgcctcagcctcctgagtagctggggctacaggcgcctgccaccacacccggctaatttttgtatttttagtagagacagggtttcaccatattggccaggctggtcttgaactcctgaccttgtgatccgcccgcctcagcctcccaaagtgctgggattacaggcgtgagccaccgctcctggcctattcttttcttttcagagacaaggtctcactctctcctctcgcccaggctggagtgcagtggtgtcatcatagctcattgcagcctcaaactcctgggctcaagcaatcctcccacctcagcctcctgagtagctgggatcacaggtgtgtgctacctcacccagctaatttctaatttttttttgtagagactggatctcactgttgccttgaactcctgggctcaagtgatcctcctgcctcagcctcccaaagtgctgggattccagaccagccattttttttccttaatcatgcattcctgttgctagtttcacatcagtcccctggtttaataagaaataaaatattttcttcacacttttgaaaaaaaaaaaaaaaa

SEQ ID NO: 92 - DNA, 1257 bp, Homo sapiens
aatagagtctgcactaggaaactggtgggagccgaggtccggaagtccgacgctggtcggtgggcgcatgcgcagcgcgcgctctacggcgctgaaccggggcgagcagagagctgtcagatactatagccatatgaagttgaacatggcagaagaagaggactatatgtctgattccttcattaatgtccaagaagatatcagaccaggattgccaatgctaaggcaaatccgagaagcccgtcgaaaagaagaaaagcaacaggaagccaatttgaaaaacaggcagaagagtttaaaagaagaagaacaagaaagacgtgacattgggttgaagaatgcactaggctgtgaaaacaaagggtttgccttgctccaaaagatgggctataaaagtggtcaggcacttggcaagagtgggggtggtattgttgaaccaattcctctcaatatcaaaacagggaaaagtggcattggtcatgaggcatcattaaaacggaaagcagaggaaaaattggaaagctacagaaaaaagattcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaa

SEQ ID NO: 93 - DNA, 2041 bp, Homo sapiens
gggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaagctctgctgtctcaggatgctgatgagacccagggcgaaagtttagagagtagagtgacccttggatccctgacagcagaatcccaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggcacaaaaaaaaaaaa

SEQ ID NO: 94 - DNA, 3340 bp, Homo sapiens
agcgcgggccgcggaacatgcgccgggagcggggcccgggcgggactccggagctggtactgctccccccgcgctccggcgccgggcctcgccgtgcggcctccttcctcccttcctcccgcccggctcggccggaggcggcggcggaggggcgaggcgcggccccccttcggcggcacctcctccccgggcaggcgcgggcggagccgggcccgcctcagccagccgcggcgggagcagcgcagcgcggcgccgcgggcagcgagctccgcattcgaacctccctcgcaaagacagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatgaaaaaaaaaaaaaaaa

SEQ ID NO: 95 - DNA, 7287 bp, Homo sapiens
agttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgt

SEQ ID NO: 96 - DNA, 1781 bp, Homo sapiens
gtcacgtgatgaagccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaaaaaaaaa

SEQ ID NO: 97 - DNA, 1103 bp, Homo sapiens
cagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctaggtccaaatgccctagtcacatggcagacccacggcctggcccactgtataaaataaacctgtttgcttcttagtttgaaaagtagaaagccacagtaacctgggtagcaaagactgagattgccccatcacagaggtgagttaaggggagagaattggtacaggcgagtcctatagtccaagatggcgccacaccaccaaagccttgaggccacaccactccccaaaccacacaactgtgttaccatgatctccacagcaaggaggaaataaaagcagagcggctttagggtttgcaaaaaaaaaaaaaaaaaa

SEQ ID NO: 98 - DNA, 1792 bp, Homo sapiens
gcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 99 - DNA, 3069 bp, Homo sapiens
cgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttctcctgg

SEQ ID NO: 100 - DNA, 4194 bp, Homo sapiens
gtcgcgctgcccccggcgagccgctcaggcgggggtggggtaagctcccgcggccggtcgcttttctccgccgccgctggttggatcgtttcaataaaagtgttttttctcttgcactcgctctcctccggggaacaggcggaggcgtcaatccgcagccgccgagtgtgaaagcgacgcacacgcaaggagcgaacgcggccgcccgcagtctcctgagctccccgcgggccgccgcagagccgcggagaaggagccagcgcccggccagacagtctcagcccgccgtcggcgcccgccgcgctcgcgcccggctgctccgaggggattagtgggccgtccgcgcggctcgtcggcgcgggagccatgttgaccgagggacttggcaacgcgtgagacacccgcggcccctcccgaggctccggacccgcggcgagagccggaaggcggctgtggcggcggaggcctgcgctcggaagcgcctcacgtctgccggccgctgagacccggacttgcatccggtcgccgcgggcgtccgcggagcagcttccccccgcgcctctcttcgcctcgcctcgggacccgcggtccccgctcttgctggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagagggtacatatgcaacagtatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatataaaaaaaaaa

SEQ ID NO: 101 - DNA, 2701 bp, Homo sapiens
gtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataagatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaaaaaaaaaaaaaaaaaaaaa

SEQ ID NO: 102 - DNA, 2097 bp, Homo sapiens
ggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaaaaaaaaaaaaaaaa

SEQ ID NO: 103 - DNA, 2127 bp, Homo sapiens
gacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaaaaaaaaaaaaaaaa

SEQ ID NO: 104 - DNA, 4307 bp, Homo sapiens
atatttggactcggctgcccgtgcccaggaatttcccgtcatgcctcccgccgccccgtccgtcgcccggagccggggagggagggagcgaggttcggacaccggcggcggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggttggagtgatgttttaatgagactgttcagctttgtggaaagtttgagctaaggtcatttttttttttctcactgaaagggtgtgaaggtctaaagtctttccttatgttaaattgttgccagatccaaaggggcatactgagtgttgtggcagagaagtaaacattaccacactgttaggcctttattttattttattttccatcgaaagcattggaggcccagtgcaatggctcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaaaaagaaaagaaaaagaaagcagcattcaaatgtaagacaactgtaaaatattgagccccacttggtctaaaattcaaaaagaagaacgcctgtccatcgcctttttataagtccttctctccacacctaaaagcagctgcagctggaagggcacaaattccactgtgtaaaataaaatattaggggcaacacacttcatcaaggcagcaggaatgagagagagcagagaagatcaaggatgaagtcttgggtactgaaaaattcagtgctgggcagaaaaactgacagggcagtacaagtaacaaacagaatccaagtggggtggcccttgtgcacagagctccaggtgacctctggagagacatgggcattcacatggaaagctaaaacggaagctcaagtttcatactcaacataatcttctgtgtgacaaaggacaagccatgtagcctctctgtgcctatttcttcatgcataaactgggactcataatatttgtaaaatgtattgatactctcagggcaaattcactatattgctatacagttgagatcagtgttgtaaaattaaactgatctggttctaattgcctcaaaggccaaagcccaggcatttgaaatggaaagaagcagagaggaggctgacttagctgattggtatggaaacagttgggccaagagccagaatttccctttgtagcaacacggctagttttactttgagaagctctgctcagctgctttataacattaagtctggcggaatggatgtcactgtgcacaataaagttttcacaagtataaacaatggtgatgtaagtcaacattgctgtagccaggtgtgaaggttgtatggtgtgtgacgaatgtacatcatgtttgtaggtttggatgctaatcttgaattgtagtttaaaaaatacgtatttttgtaactctttgaaagtttatgaagactgacagctttccttgtaagcactaagagaaaaaaaagaaagagggacatttgacaattttaaagaaacaacaagaaattagaatgaaaatctgtgacaaacagcgtcagtgtggccatgtccacattcctacatgtctctctctacaagcacctctctaagaagcctgacatcccggtggactctttatagtcatgtacacttgattccagatgagctctggtcttatctggatgctcagataagaggtttctatctgagcatccagatgttccctcaggttccaagacatttcaccccaggccctgggttcactctggaattcgtaggcttcacgtctctctagaaatgacgtgtaaaatttaagaccagacctcagccatcagcgtccagaccatcctagaagtctttcccaatctcacagagaaagccctagtatttcccagtgaccccaggattccacgttggggtggccaaagaaataggtctctcagggctttgccacagcctccagcccatccttcagaggcacacacagcacctctcggctgctccagctctgtaggatagcctcccctggggtccgtgggacgcgggccacagtgttgaggtagacaaggaggatcagtgagaggcctcttccctctccacagagactggattgtcattgttccttcatttatatcgtagggcttaacatttcactcaaaaaaaagcccctctttttctaatccttagtctttgtttcaaggaaagccagtttttcttctaccacattttccaggatcgactttaagaaaaatgcaacatctattgaaaaaaagtggggtgtatgcatgtggtttaattccagattgcttttgggtttaagtggtatcaaatttcagtatatttctgtcttatgtgaaagaaatatattactaaaacgtcagtgagcaataatgtcagctgtcaagcactagatttatttttgcaggatatggagtgcaatgaactgagtcaatatggcaaggtgtatgtgatctgtgggagttatgccatttaacataggaagtgcatgggactttccctctctgcactccagctcttactgtaccattagaagatgcagaattctgttggtgtgcaaaaagtatagccttacattcaagcagaatggatctgaagaaagcagcaatatctgttactagagaacattcccatgtgtttaaactcttcacttcttagatgcatttaaattcttaatgcaaatgacgtagcaatttgaaaacttctccgtattacttgtgtttaaaatgtcttgctttaaatacaaaacaaatggtaaaggggattatcttttgtttagatggttaaatattatttttgccttagatagctttgtaataatttttctccagacagttcaacacttttgaaaaatgacatgaattttcattaaaaacccttttcctatgtttattgtatacaagaattatgcaataaaatttctttataaaaataaaaaaaaaaaaaaaaaa

SEQ ID NO: 105 - DNA, 4708 bp, Homo sapiens
gtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacagtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaacatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttggtaggcaaatagaccaattgatctttattattattattattattattattattattttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtca

SEQ ID NO: 106 - DNA, 1179 bp, Homo sapiens
tactcagggtgagtctgggaagctggaactacacctcccaggaagctagggggtagatggtttgtttccggaagcaaagccccaggtgggtgggacctaaagctgggagactacggaggcagctctcaattggtcaggatgcgagattgacggctgcaataactaataggaacaagctactgccgaaggggcccgcccacagaagggtggtggccacggtccaggctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctccacaaaaaaaaaaaaaaaaaaaaaaaaaaaaaa

SEQ ID NO: 107 - DNA, 1876 bp, Homo sapiens
gagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaaaaaaaaaa

SEQ ID NO: 108 - DNA, 4953 bp, Homo sapiens
agggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggacagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctagtaaaaa

SEQ ID NO: 109 - DNA, 2352 bp, Homo sapiens
agtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttataa

SEQ ID NO: 110 - DNA, 1854 bp, Homo sapiens
ccagaatgctggagcgtaggtgaaaggacaaaagccagacacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtcttttt

SEQ ID NO: 111 - DNA, 2206 bp, Homo sapiens
ctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgaaaaaaaaaaaaaaaaaa

SEQ ID NO: 112 - DNA, 6160 bp, Homo sapiens
gtcctttcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaatacatggcccaaatggagaagaagttggaggaggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccaggtaagaaaatataaaatgaggtttattttattttaataacataacactgttgctcattttgtaagtatatgtgttatagcagtttcattcaagaaaagtttaaaattaaaaagtgattatcaaagaatatcagggcctgacatccacaaaaaacaaacttaattttgattgaactaataatttataaacatgggaaacaagtcagaagtagtgacattattcctagaaaagatttaaggaaagcaaaaagacaactggtaagattaagaagccattaaccatttgcaatttatattatagtcacagaaataatttcagttatgactagctcttgccgattaatgagaagagagcagctccacaatttttaatttttttaacttttattttagattcaggggtatatgtgcaggtttgttacataggtaaactgcatgtcatgggggtttggtgtgcagataattttatcacacaattattaatcataatacccaataggtttttttctgatcttctccctcctcccaacctacaccctcaagtagaccccagtgtctcttgttctcctctgagtatccatgtgttctctttgtttggcccccatttataagtgagaacatgtggtatttgggtttctgttcctgtgttagtttgcttatgataatggcttccagctccatccatattgctacagaggacatgatcttgttgttttttatggctgcatagtattccatggtgtttgtatataccacattttcattatccagcctattattaatgcacatttaggttgattccttatctttgctattgtgaacagtgctgcaatggacatacacgtgcatgtgcctttatggtacaatgatttatatttccttgggatatgcattcctttgggaataatgggattgctgagttgaatggtaattctgagttctttgaggaatcaccaacctgctttccacagtggctaaactaatttacactcccaccaacagtgtatgtgttccattttctccacaaccttgccagcatctgttatttattgactttctagtaacagccattctgactggtgtgagatggtatgcatttctgtagtgattagtgatgatgagtgatttttatatgctttttaaatgcatatatgtcttcttttgaaatgtgttcatgttctttgcccactttctttttaatggggttgcttgtttttcgcttgtaaattttttgaagcttcttatagattctggatattagatctttgttggatgcatagttggcaaatattttctaccattctgtaggttgtctgttactttgttaattgtttcattttgttttgtttttgttttttgaaacagggtctcactttgacacccaggctggagtgcagtagcacaaacatgggtcattgtagcctcaacctcccaggctcaagcagtcctttcacctcaaccccccacatagctgggactacaggtgcttacacccaagaccagttaattttttgtatttgtttgtagagatgtgtttttccatgttgcccaagctggtcttgaactactgagctcaagcaatctgcctgcttcagcctcccaaagtactgggatttaggcatgagccaccacatctggccaatagtttcttttgatgtgcagaagctctttaatttaattagatctcctttgtcagtttttgtttttgctgcaattgcttatgttatcttcatcatgaaattttagccaagtcttatgtccagaatggtatttcttaggttatttttcagagtttttatagtttaatgttttatatttaagtctttaatccttcttaagttgatttttgtatgcagagtaagctgggggcccagtttcaatcttctgcatatggctagccagtaatcccagcaccatttattaaatggggacttctttccccattgcttgtttttgtcagctttgtccaagatcagatgattgtaggtgtacagcattatttctggactctctgttatgttccatttatctgtgtgtctgtttttctactaataccatgctgttttggttactgtagctctgtagtatggtttgaggtttggtaacttgatgcctccccttttgttctttatgtttaggattgccttggctaggctcttttttggttccatatgaattttaaagtagtttctaattctgtgaagaatgtcattggtagtttgatagggatagcattgaactatttgctcaactcaacattttaggaatttatttctgctgtctagtgctcaaaacttgcagctagaattgagggaagagagagaccttcttatattgttttatattgtttgatactcagtacctgttttaagaaaaaacaacaaggaagtaaaaccaaagacaggcagcccagcgccaggcccaaaaccaggcctgggcctgcctggcctaaacccagtagttaaaaatcaactcattgcctgtaatcccagcactttgggaggccgagacgggtggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccaggaggcggagcttgcagtgagtcgagatcgcgccactgcactccagcctgggcgacagagcgaaactccgtctcaaaaaaaaaaaaaaaaaatcaactcataacttagaaaccgatgttattcatagattccagacattgtatagaagaacatttggaaactcactgccttgttctgtttctctctgaccaccagtgcatgcagcccctgtcatgtaccgcctgtttgctcaaatcaatcatgaccctttcatgtgaaatctttagtgttgtgagcccttaaaagggacagaaattgtgcattcaaggagcttggattttaaggcagcagcttgctgatgccaccagctgaaaaaagcccttccttctccaactcggtgtctgagaagttttgtctgcagctcatcctgctacagaatgaactccttgtaattctacaagatatgccatgggccttttcacaggggacacaggcttcttaaaacaacccggcttcctcaccctatgtcctttatttacaaagctgtgctcctattcatgagcatggaatgtttttccatttgtttgtgacatctcttatttctttcaggggtatcttgtaattctcattatatatatcttttgcttccttggttagctgtatttttaggtattttagtcttcttgtggcaattgtgaatgggattgcattcctgatttggctcttggcttaatgttattaacgccacattttttaaatagacaaaaatatgagattaaaaatgttgaattttactaacaataaaagttgttcaaaggaaaactataaggttcttgtttcaactctgtcataggaagaacaggacagtgagctggcacagagttagggaaactgactgtgtctcatattggctagtgagagtgatctgttggaattgtatatcaaaattttaatgtacatacattttgtctagcaattctactattgggtatttatatagtacatataaatataaatgtatatgtttagtaaatatatacttatagttagtaaatatattttatatctatttagtaaatatactaaatgtcaggcctctgagcccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattgctcacaaaaaaaaaaaaaaaa

SEQ ID NO: 113 - DNA, 6914 bp, Homo sapiens
gcggccgccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacaaaaaaaaaaaaaaaaaaaaaaaaa

SEQ ID NO: 114 - DNA, 11016 bp, Homo sapiens
cttccgctggtggcctagagcggggcccggtatggaggtgggctagaggccgacgccagccagagagcgaaatgttcttttggggccagagtctgggcatatatgaatgcaaatccgtgtttgttcacaactaagcccagctgagacgatcacttttctgtaggccatttgtccaggtacagaatgagcacatgttgttggtgtacgccaggtggtgcttccaccattgacttcctaaagcgctatgcttccaacactccgtccggtgaatttcaaacagccgacgaagacctctgctactgcttggagtgtgtggctgagtaccacaaagcaagagatgaattgccattcttgcatgaggttttatgggaattagaaaccttacgtctcataaatcactttgaaaaatccatgaaggcagaaattggagatgatgatgagttatatatagtagacaataatggagagatgccactgtttgacatcactgggcaagactttgaaaataagcttcgagttcctcttcttgaaatactgaaatatccttacttgcttctacatgaacgtgttaacgagttatgtgttgaagcactttgtcggatggaacaagccaattgctcctttcaggtgtttgataaacatccagggatctatttgtttttagtccatcccaatgaaatggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtatttgcatgttgctgaccattcttgaggaacaagccatggattccctgttgttgggctcagacaaacaaaatgattttatgcaatcgatacttcacactatggagagggaagcagatgatgatagtgtggatcctttctggccagcgttacactgttttatggtgattctggatcgccttggatctaaggtctggggtcaacttatggatcctattgtggcatttcaaaccattatcaacaacgcaagctacaatagagagatccgacatatacggaacagctctgtaaggaccaagttagaaccggagtcctatttggatgatatggtgacttgcagccagatcgtatacaattataatcctgaaaagaccaaaaaggattctggatggagaacagccatttgcccagattattgtcctaacatgtatgaagaaatggaaacattagccagtgtacttcagtcagatattggtcaagacatgcgtgttcataacagcacatttctatggttcatcccttttgtccagtccctcatggatcttaaggatttgggtgtggcttacatagcacaggttgttaatcatctgtactctgaagtcaaagaagtcctcaaccaaacagatgctgtgtgtgacaaagtcactgaattttttcttctaattttggtatcagtgattgaactgcatagaaataaaaaatgtttgcatttgctgtgggtaagttcccagcaatgggtggaagccgtcgtcaaatgtgccaagcttcctaccactgcgtttacacggagttctgagaaatcatctggaaattgctccaaaggaacagcaatgatatcttcactgtcattgcattccatgccatctaactctgtacaacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccatgagctacaaagttgcttaaagcaaattattagaaacataaaattcaaagcacctccatgtaacacttttgtggatctgacttctgcatgtaaaatctctcctgcatcttataataaagaagaaagtgaacaaatggggaagacgtctagaaaagatatgcattgtttggaagcttccagcccaacattttctaaagaaccaatgaaagtgcaagacagtgtattgatcaaagcagataacactatagaaggtgacaataatgagcaaaattatataaaggatgtgaaactagaggaccatctcttagctgggtcatgcttaaagcagagtagtaaaaacatttttactgaaagagctgaagatcaaattaaaataagtacaaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatca

SEQ ID NO: 115 - DNA, 2980 bp, Homo sapiens
ctttggaagtcctatgagggaccatttacggtttcctcagtaatttccaccaggatgaatttccttctcatcactctgcctcaggtagtgctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaagaacagccatttttctgacttcatggacaagcaaactgggtatgtcactaagaacctgctggcaaccccgatcgtggtgggcaaggaggttcttgctgtgatcatggcagttaacaaagtaaatgcatctgaattttccaaacaggatgaagaggtcttttccaaatacctcaactttgtgtctatcatcctaaggcttcatcacaccagctacatgtacaatattgaatcccgaagaagccagatccttatgtggtcagccaataaagtatttgaagaactcacagatgttgagcgacagtttcacaaagcgctctacacggttagatcatatctgaactgtgaacgatactccattggactgctggacatgaccaaggagaaggaattctacgatgaatggccaatcaagcttggagaagtagagccttataaaggtccaaagacacctgatggcagggaagtcaacttttataaaatcattgattacattttacatggaaaagaagagatcaaagtgattccgacgcctcctgcagaccactggacactcattagtgggttgccaacatatgttgctgaaaatggatttatctgtaacatgatgaatgcccctgcggatgaatacttcacatttcagaaaggacctgtagacgaaactggttgggtcattaagaatgttttgtccctgcctattgtcaacaagaaagaagatattgtgggagtggctacattttacaacaggaaggatggaaaacctttcgatgagcatgatgaatacattaccgagactctcacacaatttcttggatggtctcttttaaatactgacacctacgataagatgaataagctagaaaacagaaaggacattgctcaggaaatgctcatgaaccaaaccaaagccactcctgaagaaattaagtccattttgaaatttcaagagaagttaaatgttgatgtaattgacgactgtgaagaaaaacaacttgttgcaattttgaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggttcttaccagatggatgtacactgtgaggaaagggtaccgagctgtcacttaccacaattggcggcatgggttcaacgtggggcagaccatgtttactttgctgatgacaggaagattaaagaagtactacacagatctcgaagcctttgccatgcttgctgctgctttctgccatgatattgaccacagaggcaccaataatttgtaccagatgaaatccacgtctccattagcaagacttcatggttcttctattttggagaggcaccacctggagtacagtaagactctgttgcaggatgagagtttaaacatcttccagaacctaaataagcggcagtttgaaacagttattcatttgttcgaggtcgcaataatagcaactgacctggctttatatttcaagaagaggaccatgtttcaaaaaattgttgatgcctgtgaacaaatgcaaacggaagaagaagccatcaaatatgtaactgttgatccaaccaagaaagagattatcatggcaatgatgatgacggcatgtgacttgtctgctattaccaagccctgggaggtgcaaagtcaggtagcacttatggttgcaaatgaattttgggaacaaggagatctggagagaacagtgttgcagcaacaacccattcctatgatggacagaaacaaaagagatgaattacctaaacttcaagttggatttattgattttgtttgtacttttgtatataaggagttctcacggtttcacaaagaaatcacacctatgctgagtggtcttcagaataacagagtagaatggaaatcactagctgatgagtatgatgcaaagatgaaggtcattgaagaggaggcaaaaaagcaagaaggaggagccgaaaaagctgctgaagattcaggaggtggtgatgacaaaaagtccaaaacatgtttaatgttgtaatattatctaactggtctaaacttcaaatatcattttacctttgaagaaaaccagaaaacattcaaaagaacttcaacaaatcatcacgtaacaggatcttcagaaaaactaccctgtgactatgaagaaaatatatattgctagcccaaaaatcccaggggcaaaataaagttcaacaaaagtgcaaaatatgacaaaaataggtacatttttggtgccaatttattttaaattaaaaaatatgcaatcctgaaaaaaaaaaaaa

SEQ ID NO: 116 - DNA, 1319 bp, Homo sapiens
atacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacga

SEQ ID NO: 117 - DNA, 2483 bp, Homo sapiens
agttgattgcaggtcctcctggggccagaagggtgcctgggaggccaggttctggggatcccctccatccagaagaaccacctgctcactctgtcccttcgcctgctgctgggaccatgggggctggggccagtgctgaggagaagcactccagggagctggaaaagaagctgaaagaggacgctgagaaggatgctcgaaccgtgaagctgctgcttctgggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcgcaagaagtggatccactgcttcgagggcgtgacctgcatcatcttcatcgcggcgctgagcgcctacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaagatcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaatttgtcttcgacgctgtcaccgacatcatcatcaaggagaacctcaaagactgtggcctcttctgaggccagggcctgtgctgcagtcggggacaaggagcttccgtctggcaaggccggggcacaatttgcactcccctcagctagacgcacagactcagcaataaacctttgcatcaggctccagctgtcctttcttggtggaggacttaattatcacaagtcatgggcatttattaagtgcccagtgctgggttgggcatgaagtgggaagatggcccctcccaggaagaagtacctggcctgacaaggtggggcactcttgggggtatgggaccaactcatggcttttcacgggagttgaggagagaggagctgtggaaaatattcactgggacagtcttggatcaagagggagttttgaggtggaggctcattctggcagggaccgtagtgtctaccagccccagaaacatgggcttatggccacaggagttcagtggagcaagagcaggggaggagagacgtggacaggtgcccaaagccagtcggagggcctgggctttctcagaaggtgatggagagtcttggaagccctcgaggcaggaacataattgcagggctgggattagggtgagggaagtgaggcacactcaccttgggtgcaacatttaaggcgatgccaaaaaatttagtaaccaaggtaaataatattaggataatatttttaaaaatcaaatgaatgcaaaaccccacaatgaatgaaatatcaaaatccaacagaggatcaaacagaggcatgctaagatatattggggcttgaagcaaagggaaaactatttgttgctatatgtttgtagggattttttgccagttttaaaaatacatgtatcataaagtttactatctcagccacttgccggtgtatagtttggtggtgttaagtacattcataatgttgtacaaccaccgcaactgttcatctccagaactcctttcctcttgtaaaactgtaactctgtacccatgaaaaaataaccccccattcctgccttcccccggctcctggcatccaccattctactttccatctctatgaatgtgactgctctaagtgcctcagatgtgtgggtccatgaagtctttgtctttttgcaactggcttatttcacttagcatcatgtcttcaaggtttattcatgtgtagcatatggcagaatctccttcctttttaaggttgaataatattccattgtatatattccacactttgtttatttattcatctattgatgaatggttacatctgccttttggctattgtgaataatgctgctatgaacatgggtgtacaaatctctcaaaaaaaaaaaaaaaaaa

SEQ ID NO: 118 - DNA, 8559 bp, Homo sapiens
gaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactata

SEQ ID NO: 119 - DNA, 5157 bp, Homo sapiens
agtgacgtcacagctaagcgcctctgtatcgtcgcgaatccgtcgcggaacctgtcttctgtctttacccagagctaccatgagcaagcggaaccaggtatcgtacgtgcggccagccgagccggcgtttctggcccgcttcaaggaacgggtcggctacagggagggacccaccgtagagactaagagaattcagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattacgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcagagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtaatcccaacactttgggaagccaaggtgggagaattgcttgaagccaggaatctgagcccagcctgggcgacaaagcaatacccctatctctacaaaaaataaaaaatagccaggtgtagcgacacacacctgtagtcccagctgctcaggaggctaagcaggaggatggcttgggcccaggagttcaacgctgcagtgagctatgattgcaccactgcactccagcctgggcaacagagtaagaactgtctcaaaaaaaataaaaaatagaaataaattttaaaaaaagaattacccatattctctttgtttttgtttattcacattaacctttattctatctggaatttattagagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccaggctggagtgcagtggcgcgatctcagctcactgcaagctccgcctcctgggttcacaccattctcttgcctcagcctcccaagtatctgggactacagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatgaaaaaaaaaaaaaaaaaa

SEQ ID NO: 120 - DNA, 989 bp, Homo sapiens
tttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataataaaaaaaaaaaaaaaaaa

SEQ ID NO: 121 - DNA, 3905 bp, Homo sapiens
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctaaaaaaaaaaaaaaaaa

SEQ ID NO: 122 - DNA, 6894 bp, Homo sapiens
cgggcgggaggagccgctcgccggttttgccgcctccgcctttgccttcgcagccgcctccagtgttgtacattataaaccggggctgctgatgaggagtggggaactggctctctggaacgtgtgacagcaggcagaagggggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgaggacgtcatcctgctgggtgcgcctgtggagggagaagccaagcattgggagcctttccggaaggtggtgtccgggaggatcatcaacggctactgcaggggagactggctgctgagtttcgtgtaccgcacatcctcggtgcagctccgtgtcgccggcctacagcccgtgctgctgcaggacaggagggtggagaacgtggacctgacctctgtggtcagcggccacctggactatgccaagcagatggatgccatcctgaaggccgtgggcatccgcaccaagccaggctgggacgagaaggggctcttgctggccccaggctgcctgccctccgaggagcctcgccaggcagcagctgccgcctcatcaggcgagaccccccaccaggttgggcaaacccagggtcccatatccggagacacctccaaattggccatgtccacagaccccagccaagcccaggtgccagtagggctggaccagtctgaaggggcctcccttcctgctgctgccagccctgaaaggccccccatctgcagccatggcatggaccccaacccactgggctgccccgattgtgcctgcaagacccagggccccagcacggggctggactgaccacagcaggggacctgagccgtcttccccagtctccatatgcagctctctcttataccctcgggttcctcccaggagctctggaggtacaggatttccacaggcctctttcctaaatggaaggaattggaactgaaagggaaaggaaatggaaggaaggggaatttggaggagagaacacgcccacccttgggaagctgcctgtccccagaggagccccaccagggagcagctgccccctcatcagagacctgcagagtcaaccaagcacaggttagagtcccaggaccggaaaccaactgtgggctttctgtacttctcatagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacaccactaacagagcatggtgaatacatgctgaattgcattcagtatggctgtgaactaggcctggggacaagaatgaattttacatggaaagaatttcctgtagcaggaacagaggggataacaacagcaataaataataataagaagaagctaccacttcttgagcatgtaccacaaaaaaaaaaaaaaaagcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctaaaaaaaaaaaaaaaaa

SEQ ID NO: 123 - DNA, 1768 bp, Homo sapiens
ttttcctgctttcggagccggccagtgcgggaaccgtttccgaagggaccaccgggaacagacggatcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatgcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaaaaaaaaaaaaaaaaa

SEQ ID NO: 124 - DNA, 2993 bp, Homo sapiens
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaa

SEQ ID NO: 125 - DNA, 683 bp, Homo sapiens
agcactgcagggctctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgttgttgtctgaaaaaaaaaaaaaaaaaa

SEQ ID NO: 126 - DNA, 2485 bp, Homo sapiens
tgagtagcattcattgaatctgcggatttcatgacgtctctctgcgtggtccaccacttttctcctaaccggggattttttttttcttctgccactcttatctttccccacttcattccacccagtctccctcccccgtccctgcccaaacgcgcgcccctccgcccctcccttggccccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccagagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggacgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttagtgccctagctgggcaaacccttctcttctccccccaacacaatctttccttgtctctcattctctttctttttctgtctctcttgctttgttctttatttgtttatatttaatttttacatgaccagaaaacaaatcttcaaggtgtaaaatatctacctgccctctctcagttattcagattgacaaggtagacatggatttgatgaaagtgcaaagtgccctcatttgtggcccaagcctggtctcctcccaaaatactacacatccaactcctggagatttcagttacttacctgcatgtgttgtacaataccagatcactcaaaaaggtgtgtcaaagattttacctgggatatgacaagcaaggtttctggtgcctatttattcattcagtgagacacagagtggagccctcagttttatggatcccaattcatttcatctactacagggtgaggtgcttgcccccatgtgggtgtggcagttacagggcccaggtgagctgaagacaaaccactgtacatatatatgccttatgtaattattttctttttgtaattagtaataaaacccagcatgtacaaaagtaccatagaacagaactgctaaatactgtacatagatgtatcattaatgtaggtttagatatataactttagaaataagaagcaaaa

SEQ ID NO: 127 - DNA, 6985 bp, Homo sapiens
gcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaagttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctgtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaatggtcaacgttatttttgttttgttttgcagattatcaaagcctagcaaaatgcatttaaatgaaatagtgggttttatatgaaaactatgggtggggtggggagggaaagtaagtgccttaacaggtaagcttaaggtctgaaaaaaatagttaacttttacccccatttgtcttttaaagggaatcaatgcattaaaaaggcaagaaactctgaagtttcaggggctgcctgttcagttcctgttaggtccattccctctgcttgtcacactttctccttttctgcctgtctttgggctgtgttgcctttcactaccaccttctcttgataggggagtgagagcaaagaaagggagtagaactgcaatcagtacatattgtttgagaagttctacaaagttttgtcatttaaatggttgaaagtaatagctccaggagaattttagagtaccattttctttcaggctgccatattatccctgtttccatttgccatggataattggagggtcatggtatagaagcaagagttaataacagaacttgcctaaatgtgttaaagttcatgggggaggggtggcaaataccgtattttaagttatgcaattgcccttttaagaaagtcaattctattcacttgttaactagaaacattgcttagattgaatttattgaagcaaaaagaaaaggcaatgagagagaacttttatcttccttcctgtcacattctgtaaagttgattatgacttctgccagacttagagcaacaactttagttcattttaacatttttttttaatgaagagcatcaaagaatggagtagtccttatttaaactgtaatggtgtcaagtctcactgtgtgcacactctcacacatacacacacaattatactaattctagaaaggaaccaaaggtaaataaccagtgtttccattatcactaaatggaaaaattgactggaagttagagttgtgccaattaatcattttgttcatcaactgttctggtaacttatttttttttattggaatcttaaattggaacaactgttacagaatgtatattgctccagttctaaagccagttaaccctgtgccctctaacttatgaaccttcatttcaaaacagtatgtgggaagtcctgtagtttgataagagtaaaattattttaaagaggataatttaccattttactactataaaataagttgatatcagttgaccattttattttttgatggactctttttgttgggagaaagaaatgaatggaagaaaaaaatatgttgcttttatttgaatattgattactaacaacttataaactacattgcaggaaatgaagaaatattttgaaattagcaaaatagcaacagtattcaagtatctgaaattttaatatggtgagtcttagagctttagactttcctataagtgacagtatctaagttattcttaatagtcacacttgataattctgctgaccataagcagctaacctacagttgaagatatttatgtgacatgaatagcctgtgttttaaaaattaaatattttatataaaattgaaaaaaaaaaaa

SEQ ID NO: 128 - DNA, 835 bp, Homo sapiens
cagacgacgtgctgagctgccagcttagtggaagctctgctctgggtggagagcagcctcgctttggtgacgcacagtgctgggaccctccaggagccccgggattgaaggatggtggcggccgtcctgctggggctgagctggctctgctctcccctgggagctctggtcctggacttcaacaacatcaggagctctgctgacctgcatggggcccggaagggctcacagtgcctgtctgacacggactgcaataccagaaagttctgcctccagccccgcgatgagaagccgttctgtgctacatgtcgtgggttgcggaggaggtgccagcgagatgccatgtgctgccctgggacactctgtgtgaacgatgtttgtactacgatggaagatgcaaccccaatattagaaaggcagcttgatgagcaagatggcacacatgcagaaggaacaactgggcacccagtccaggaaaaccaacccaaaaggaagccaagtattaagaaatcacaaggcaggaagggacaagagggagaaagttgtctgagaacttttgactgtggccctggactttgctgtgctcgtcatttttggacgaaaatttgtaagccagtccttttggagggacaggtctgctccagaagagggcataaagacactgctcaagctccagaaatcttccagcgttgcgactgtggccctggactactgtgtcgaagccaattgaccagcaatcggcagcatgctcgattaagagtatgccaaaaaatagaaaagctataaatatttcaaaataaagaagaatccacattgcaaaaaaaaaaaaaaaaaa

SEQ ID NO: 129 - DNA, 3654 bp, Homo sapiens
agatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagatttttttttaaaaaaaa

SEQ ID NO: 130 - DNA, 1038 bp, Homo sapiens
aggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcggtttgggcccaggaacaggcaaaaaaaaaaaaaaaaaaaaaaaaa

SEQ ID NO: 131 - DNA, 1218 bp, Homo sapiens
atggactctcttgttacagcaaacaccaaattttgctttgatctttttcaagagataggcaaagatgatcgtcataaaaacatatttttctctcccctgagcctctcagctgcccttggtatggtacgcttgggtgctagaagtgacagtgcacatcagattgatgaggtactacacttcaacgaattttcccagaatgaaagcaaagaacctgacccttgtctgaaaagcaacaaacaaaaagctgggtccttaaacaatgagagcggactggtcagctgctactttgggcagcttctctccaaattagacaggatcaagactgattacacactgagtattgccaacaggctttatggagagcaggaattcccaatctgtcaggaatacttagatggtgtgattcaattttaccacacgacgattgaaagtgttgatttccaaaaaaaccctgaaaaatccagacaagagattaacttctgggttgaatgtcaatcccaaggtaaaatcaaggaactcttcagcaaggacgctattaatgctgagactgtgctggtactggtgaatgctgtttacttcaaggccaaatgggaaacatactttgaccatgaaaacacggtggatgcacctttctgtctaaatgcgaatgaaaacaagagtgtgaagatgatgacgcaaaaaggcctctacagaattggcttcatagaggaggtgaaggcacagatcctggaaatgaggtacaccaaggggaagctcagcatgttcgtgctgctgccatctcactctaaagataacctgaagggtctggaagagcttgaaaggaaaatcacctatgaaaaaatggtggcctggagcagctcagaaaacatgtcagaagaatcggtggtcctgtccttcccccggttcaccctggaagacagctatgatctcaattccattttacaagacatgggcattacggatatctttgatgaaacgagggctgatcttactggaatctctccaagtcccaatttgtacttgtcaaaaattatccacaaaacctttgtggaggtggatgaaaacggtacccaggcagctgcagccactggggctgttgtctcggaaaggtcactacgatcttgggtggagtttaatgccaaccacccttttctctttttcattagacacaacaaaacccaaaccattctcttttatggcagggtctgctctccttaa

SEQ ID NO: 132 - DNA, 599 bp, Homo sapiens
cccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcatgaaaaaaaaaaaaaaaaaa

SEQ ID NO: 133 - DNA, 3027 bp, Homo sapiens
cagcgttcaggctgccccttcttggctgggaagggcgctgaagaaacaacgcccaggaccaggactatcccctgctcaagctgtgattccgagacccctgccaccactactgcattcacggggatcccaggctagtgggactcgacatgggtagcccccagggcagctccctacagcttgggccatctgcacttttcccaaggccctaagtctccgcctctgggctcgttaaggtttggggtgggagctgtgctgtgggaagcaacccggactacacttggcaagcatggcgctactgaaagtcaagtttgaccagaagaagcgggtcaagttggcccaagggctctggctcatgaactggttctccgtgttggctggcatcatcatcttcagcctaggactgttcctgaagattgaactccgaaagaggagcgatgtgatgaataattctgagagccattttgtgcccaactcattgatagggatgggggtgctatcctgtgtcttcaactcgctggctgggaagatctgctacgacgccctggacccagccaagtatgccagatggaagccctggctgaagccgtacctggctatctgtgttctcttcaacatcatcctcttccttgtggctctctgctgctttctgcttcggggctcgctggagaacaccctgggccaagggctcaagaacggcatgaagtactaccgggacacagacacccctggcaggtgtttcatgaagaagaccatcgacatgctgcagatcgagttcaaatgctgcggcaacaacggttttcgggactggtttgagattcagtggatcagcaatcgctacctggacttttcctccaaagaagtcaaagatcgaatcaagagcaacgtggatgggcggtacctggtggacggcgtccctttcagctgctgcaatcctagctcgccacggccctgcatccagtatcagatcaccaacaactcagcacactacagttacgaccaccagacggaggagctcaacctgtgggtgcgtggctgcagggctgccctgctgagctactacagcagcctcatgaactccatgggtgtcgtcacgctcctcatttggctcttcgaggtgaccattacaattgggctgcgctacctacagacgtcgctggatggtgtgtccaaccccgaggaatctgagagcgagagccagggctggctgctggagaggagcgtgccggagacctggaaggcctttctggagagtgtgaagaagctgggcaagggcaaccaggtggaagccgagggcgcagacgcaggccaggccccagaggctggctgagggccctggggcccctcccctcccgaacactgagaaatagtgcactccaagaaacgtggatctccccctcatccaactccgaaagtctgaatctcccaaggagggcaccatcttacagagactctccctgacggtggaatttaagtttagggtccctaaaagcatttgacacacagttgttgaatgactgacccaaaatgtgaatgaagctaatgtgaatgtgagtgaagctcccttcaggcccgctgccctaggatatgccctcctggtgactcgggggctgtctcagacgactagcccaggacccatctttctcacacggatttagtcccaccctatggccactggccgtatctgagggctgctccccttttagaatttacctcttatgagctccatgttgcttcactctatccaaagtgtcacttggtgcataagcacagaaatctgaaaaatggccatgttgtcttttttttttttttttaatgccaagattgacaggttggccgtttgcttaatgccagaagttgggggaaagttacgcttttctaagaataatggactcttaaggcattgagggctctaaacaggattctttaatcatggagcaagagaatttcaaggcaggggattttatcccccaccaaaaacacagtgaaaggcctgcttttgtgtcccattcacatgccctcggtcactgagtctggagtgaaccacgggttgaggaagtcaggctgttggcgtgtcccagcaccacaccacccctaaagtgccaggtgatctcctgtggctcatcggtggaagcagtggggtaggctgctgccctgctgtggaagaggagcaacaatcagacatgagtccaccctttggagaccaggcctcagctcttggtgggcccagggacacccacacaggtggccatcacagccccatggacaacactaattgtccacagcaaagggcaaggaatcctctgggagcttcttccgtttcttccccccagatacccatcttgaaaaacactatttctggaatgcttctgcatcaaaggagattctttgagatagcccatcttcctgagctagcaaatacaggagttttcactttctttaggaaagagaagctttcaggggaaggagagaatgattttgctgacttcccaagccctggtgaccagaccaaggcagggcccagcataattcctccagttggatgaacattcaagagagctcgttcctacctggctggagaccgaggccagaaggcaaaaaccagaaagggaacagtccataacttacctctgcttctgaccgatggtgtttgggaataggttactttggactgagtttgggttctctgctgtcctaagaacttcagtgtagagaaaataagacttctggtgctgctggggtatgttctgggcttaattcccccaagcagaagaccagatccaagatgtttggacaccctgtcagacgttggtcccaagtttaattagatttctgaatctcgttgaggccaaggaatgatccatactgaaaaaatgctgagccagccatctttggcaaaggtccctgagctcttgctatctctcaagagtgctgagaaccacggtgaaagtgctgctctaggcccacaagtgtaactatgctgttaacagctgtcaatagataattaaaattcatactgtatgaaaatca

SEQ ID NO: 134 - DNA, 4107 bp, Homo sapiens
gcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacagggaaaaaaaaaaaaaaaaaa

SEQ ID NO: 135 - DNA, 3141 bp, Homo sapiens
agtcccatggggaatgtcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacaaaaaaaaaaaaaaaaa

SEQ ID NO: 136 - DNA, 1134 bp, Homo sapiens
ctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggggcccgacagcctggcgctggcgctggaccgcgccgtcggggggcggcggcccagcgcgcccatgacccgcgaggagtttctggagagggccgccgcgctcttcatcgcgaaggtcaagccggtgggctgaggcccgtgggccgcgcggatccgggatctgcgctggggggtccccgcgtgcggggcgcgcggagccttcccttcgccctggtgaggccctgccataaccaggcgcccagccctgcggaggaggccggggctcccaggaagcggacgcccggtccccacacagcgccgcggccgcccctccacccccgcgggagcccctgccccacgctaataaaatgtgttgcgaggctgaaaaaaaaaaaaaaaaaaaaa

SEQ ID NO: 137 - DNA, 5413 bp, Homo sapiens
gagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaacagttcaggaatccaatgctttgagaaataagaaaaactctcgtcgagtcagctttgcagatactataaaggtattccagacggagtctcatatgaaaatagtgagaaagtcagaaatggaagaaacagaagcaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattattctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatacggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgttgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagacgattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaacgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttagcaaatgttatttcctgtactgataatttggagggtagtgccatgctcttatgtgataaagatgaggaaaaagcccattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctatttacatagaaactgaggaaaaggccgtgggtacaagaagaagaagatattcataaggagaaaaaa

SEQ ID NO: 138 - DNA, 2510 bp, Homo sapiens
gaacctcagtgtgtgaagtaaagggattaaaggctagtctcaggctggggatggctcctgtctatttcttctctctcagagactgcagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctggcggtgaagtcggcgcctgagcactacgagcgacgcgagctcatccggcgcacgtgggggcaagagcgcagctacggcgggcggccagtgcgccgcctctttctattgggcaccccgggccccgaggacgaggcgcgcgcggagcggctggcggagctggtggcgctggaggcgcgcgagcacggcgacgtgctgcagtgggccttcgcggacaccttcctcaacctcacgctcaagcacctgcacttgctcgactggctggctgcacgctgcccgcacgcgcgctttctgctcagcggcgacgacgacgtgttcgtgcacaccgccaacgtagtccgcttcctgcaggcgcagccacccggccgccacctgttctccggccagctcatggagggctccgtgcccatccgcgacagctggagcaagtacttcgtgccgccgcagctcttccccgggtccgcttacccggtgtactgcagcggcggcggcttcctcctgtccggccccacggcccgggccctgcgcgcggccgcccgccacaccccgctcttccccatcgacgacgcctacatgggcatgtgtctggagcgcgccggcctggcgcccagcggccacgagggcatccggcccttcggcgtgcagctgcctggcgcacagcagtcctccttcgacccctgcatgtaccgcgagttgctgctagtgcaccgcttcgcgccctacgagatgctgctcatgtggaaggcgctgcacagccccgcgctcagctgtgaccggggacaccgggtctcctgaggccagttgggcggcttcagccccgggcctccaaccatgtccatgctgagaaggcagctttcccgctctgggtaccttacgtcctgcccagctctgtgcacctgaaccccagctgcgcactgaaatcagctggggtggggggtgtggaaaatgcctacatcctggctccatctcccgaagtttcgatttgattagtctggggtggacccagacatgttaagtattttttaagttcctccagtgatgcgaatgtgcagctaggcctgaggaccactcggctagactatctcttcatcctcgcaaagccagctccaccgccctctctgcaagaattccgggcccctcgctcccacactcgggtcctcttgagcagtggagcaagggagacctgggagcgtgggagccaggatcagcgccccctgccatgtgcctacaaatgtcagttgtgatttccactgtttacaagtgagtggagctggagctgggctgacagtatcaggtggatcccgcttccccctcccccaagaagtcagccaacacgcagctgaggcgcatgtggtggccttcttcccaccactaccccagtacaccgtgaggtagaaatcttcaccgtgcaaagtggaaaccagaggcccggtcagacagtgactaatccagggccgtggcattcccagacagcacaccactgtggtcccctccacactcaccccaaccaaagctaatggcctagttgggtcctgcccgccaataatcacccccacgggtcagagacaggctccttgccggggtctgggcctcaggctcagtgggccttggacaacccagcagggagttccggggagtccgaagtggagaaaggctggtgggaacatggaggccagtgttggggagcctgtggaggcaggtgtgtagaattgtgttcgggaggtgggggatctgagaccgaagtggacagtggttaagattgtggggccgggcgaggtggctcacgcctgtaatcccagcactttgggaggctgaggaggtcggatcatgaggtcaagagttcgagaccagcctggccaatatggtgaaaccccgtctctattgggagtacaaaaattagccggccatagtggctcgtgcctgtaatctcagctatttgggaggctgaggcaggagaatcacttgaacctgggaggcggaggttgcagtgagccgagatcgtgccactgcactccagcctgggcgacagagcaagactgcatctcaaaaaaaaaaaaaaaaa

SEQ ID NO: 139 - DNA, 1052 bp, Homo sapiens
ttaaggcacaatcagaaagaaaagctggagaattctctgaccttttgctctacaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttcgctggagtatagtggcgcgatctcagctcactgcaacctccgcctcctgggttcaagcaattctctggggcagcagttctaagctctggttgcacattaggattcctagagattcagattgaattaatttgaggatgggattattctaatgtacaaccacggctgagaaccactgccgctgacgtttcaacacaaagtttgctgtttgaacctgcctgtctcctggatttcaaagaccactgtcttcattgcacaacaatgtgaatataatcaacactattgaactgtacctaagaatagttaataaaaaactgagtgttta

SEQ ID NO: 140 - DNA, 3095 bp, Homo sapiens
caggagattgcctgctctctgaaaaaccaggaggagctggtagggaaggactggggcgtggaacagggcctcagcttgtttctcgccagttggaatcatatacagccaccactgggagggagccttggagattacctagtgaccaggggctcttatttaatcaagaggcattgcacatgcagttactttattgacgtagtgtttgcactacttcaatagtgcaaagggaggaagggaggaaggagaaaccaccctaatgcccgtgagagggtgatgtggggatgataggataaacctattcatggtgagcctccccacagactgttatgcaaccattagaaggaatgagtgagttctgtccctgctgacctggatgtgggatcacgtgttctgccaagtaagaccagtaagatttagagatgcgttcggagcaggggtggcgtggatgacaggtgacgaactgccgattaaatctggccctctgcctggctttgtacagcccgtggctaagaatggtttttacatttttaaattttggaaaaaaatcaaaaaaaggagatttttatgacacgtgaaaatgatatgaaatttacatttcagtgttcattactgaagttttgttggagtgcagccacgctcttctgtcggcacgtcatctgcatagctgcattcgcactgcaaaggcagagccgagccgtcacaggctgtgaggcagaacgtgtttattacctgacccttttctgaaaaagtttgtcggccaccgccttagagtatgatgacattttgccaaacagcagcaccagatatggttctcagcacttcagaggagtagattcattacatttgtttattcgttcattcattttatcctttattcgtcagatgcttactgtctatctgtggggccaggcaccaggaaccagcagagaacaaacagatgcaggccttcttcttgtggagctgaaagtctgtgtctagatccttcttttctcagtacaagcacttccagcctttccaactctttctcacgagtctcagtgtccagccccttgcatcctgcctcccttctgcctccccagtatgtatcctgattgcccaagtccctcccaaaaagaggtatccaaactggtcccatacttcctggggtcttgccaagaggttgagatctagtagaaggacacatcttgaattgggtcatgctttctatctggtttcaaggtgcttaacatccaacctttgccttttcagctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaatagccctagccattggtgcacaggatgggggcaatgggaggggatgctactgatgggaatgattaagggagctgctgtttaggtggtgctggtttatgttctaggaactcttcatgagcactttgtaaacaccctcttgcttaatcctcccaacggcccccaaaggtagaacttagctcccttttaaaaggagcacattaaaattctcagaggacttggcaagggccgcacagctggggcct

SEQ ID NO: 141 - DNA, 804 bp, Homo sapiens
gcgcagtgcatcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 142 - DNA, 896 bp, Homo sapiens
gttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaaaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaa

SEQ ID NO: 143 - DNA, 3690 bp, Homo sapiens
gtgctgggctgttcgtctcttctatgtgctgatttcctgggttactttgggtcttccttttctttctcccttttaccctgtctcctttcttgaggctgatcgatcacagccaggcctctccattctatttacccagcgttttccttctctccagttagtggggtagatgaacgccctgtgtttataaggtgcctcccaggagcctgagacctgtgagaagaatggggggtggaggtgggggagactcgtcacgaagggagaccttggagcttcgagggtgggaatgttcttattagattcttcatctctgttgacacaaacatgtaggagaagctggagaacatagacagggatgaggttttatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaagctgggaaacagccacgtacagtgatcattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggcctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgctatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgatactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattggaaaaaaaaaaaaaaaaaa

SEQ ID NO: 144 - DNA, 1083 bp, Homo sapiens
atggacccagaagaaacttcagtttatttggattattactatgctacgagcccaaactctgacatcagggagacccactcccatgttccttacacctctgtcttccttccagtcttttacacagctgtgttcctgactggagtgctggggaaccttgttctcatgggagcgttgcatttcaaacccggcagccgaagactgatcgacatctttatcatcaatctggctgcctctgacttcatttttcttgtcacattgcctctctgggtggataaagaagcatctctaggactgtggaggacgggctccttcctgtgcaaagggagctcctacatgatctccgtcaatatgcactgcagtgtcctcctgctcacttgcatgagtgttgaccgctacctggccattgtgtggccagtcgtatccaggaaattcagaaggacagactgtgcatatgtagtctgtgccagcatctggtttatctcctgcctgctggggttgcctactcttctgtccagggagctcacgctgattgatgataagccatactgtgcagagaaaaaggcaactccaattaaactcatatggtccctggtggccttaattttcaccttttttgtccctttgttgagcattgtgacctgctactgttgcattgcaaggaagctgtgtgcccattaccagcaatcaggaaagcacaacaaaaagctgaagaaatctataaagatcatctttattgtcgtggcagcctttcttgtctcctggctgcccttcaatactttcaagttcctggccattgtctctgggttgcggcaagaacactatttaccctcagctattcttcagcttggtatggaggtgagtggacccttggcatttgccaacagctgtgtcaaccctttcatttactatatcttcgacagctacatccgccgggccattgtccactgcttgtgcccttgcctgaaaaactatgactttgggagtagcactgagacatcagatagtcacctcactaaggctctctccaccttcattcatgcagaagattttgccaggaggaggaagaggtctgtgtcactctaa

SEQ ID NO: 145 - DNA, 11747 bp, Homo sapiens
ttttgcagtagaagagtataaccatgtttcggaatagtctcaagatgctgcttactggtgggaaatcaagtcgtaaaaacaggtcaagtgatggagggagcgaggaaccaccggatcgaagacagtcaagtgtagactctcgccaaagccgctctgggcaaggtggcatctccacagaaagcgactgtgcttttgagccagactacgctgtcccgccacttccagtgagtgaaggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaggagccaagataggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgttctagtggccctcttcctgtaaacccagatggtgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaacca

SEQ ID NO: 146 - DNA, 2716 bp, Homo sapiens
gccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcaaaaaaaaaaaaaaaaaaa

SEQ ID NO: 147 - DNA, 8518 bp, Homo sapiens
accctcttggtgtgcgcgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgctttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacgggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcagggcctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttggctacaggcctcttgtggagagtttcacgggcaggggtgattccaacttctgcctgtggagagattttctgccctgccccaccagggccctgcatgttggagactgagctgggtgcactggccatgccctgtgaatcctcaggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctgggtgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcagttcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacatttagaca

SEQ ID NO: 148 - DNA, 5395 bp, Homo sapiens
aaatagtgggccaggcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttccttcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaata

SEQ ID NO: 149 - DNA, 3977 bp, Homo sapiens
gaagtttaacagtccaggcgggagccggaagcccagcgcggagccggccgcggccccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattacttttacccagtgtggtttatagcatacatttgtactgaagcatatagggatgttaatgtgatcttttcctgacagattatgaaagcattatgacttgtaacaagtttccttgtatatcactaacaggtttagaagacataaatattagtgtgttttgcctacatggtgtatttaaatctattaatattttcctgttgcttttttaaaaaaataaatacacataatgtatattaaaagaggtgggatgaaataattttagtaattatgtgtacagatgaaacatttttgtcatggaatttaaaagctaagtaagtataaaaaataaaatgttatatgcaaaaaataaaaaaaaaaaaaaaaaa

SEQ ID NO: 150 - DNA, 2000 bp, Homo sapiens
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctcaaaaaaaaaaaa

SEQ ID NO: 151 - DNA, 7311 bp, Homo sapiens
gaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggaaaaaaaaaaaaaaaaa

SEQ ID NO: 152 - DNA, 4743 bp, Homo sapiens
ccgggaaggaagatgagggagacgggcccggcgcttagcagccagagcagcagcagcagcagcagcggtcgggggagggtgtttcgccgtttcctctcagccgccaggacaagatggcagcggccgcggagaggggctgagcccgggctgggtggtgccgcctgctgaagcgcctggctcccggtccccggcacggccctgcgccccaccccggacatgctcagggctgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacagaggtattttggtaaaactaatggaatgggagccaggaagagaggaaataaatgctttcagttggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatc

SEQ ID NO: 153 - DNA, 2924 bp, Homo sapiens
gacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagaaaacaaaaaaa

SEQ ID NO: 154 - DNA, 962 bp, Homo sapiens
agtgggggtgtgcgcagggatgcaggcagctaggctcccccactggccaggcagttggtatgctccaggatctgagcagctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctcaggacaaaaaaaaaaaa

SEQ ID NO: 155 - DNA, 925 bp, Homo sapiens; identical to SEQ ID NO: 1

SEQ ID NO: 156 - DNA, 1281 bp, Homo sapiens; identical to SEQ ID NO: 2

SEQ ID NO: 157 - DNA, 3315 bp, Homo sapiens; identical to SEQ ID NO: 3

SEQ ID NO: 158 - DNA, 1618 bp, Homo sapiens; identical to SEQ ID NO: 4

SEQ ID NO: 159 - DNA, 4201 bp, Homo sapiens; identical to SEQ ID NO: 6

SEQ ID NO: 160 - DNA, 1014 bp, Homo sapiens; identical to SEQ ID NO: 7

SEQ ID NO: 161 - DNA, 1831 bp, Homo sapiens; identical to SEQ ID NO: 13

SEQ ID NO: 162 - DNA, 2146 bp, Homo sapiens; identical to SEQ ID NO: 14

SEQ ID NO: 163 - DNA, 5620 bp, Homo sapiens; identical to SEQ ID NO: 23

SEQ ID NO: 164 - DNA, 1466 bp, Homo sapiens; identical to SEQ ID NO: 33

SEQ ID NO: 165 - DNA, 7311 bp, Homo sapiens; identical to SEQ ID NO: 151

SEQ ID NO: 166 - DNA, 1686 bp, Homo sapiens; identical to SEQ ID NO: 34

SEQ ID NO: 167 - DNA, 1087 bp, Homo sapiens; identical to SEQ ID NO: 35

SEQ ID NO: 168 - DNA, 537 bp, Homo sapiens; identical to SEQ ID NO: 29

SEQ ID NO: 169 - DNA, 2643 bp, Homo sapiens; identical to SEQ ID NO: 37

SEQ ID NO: 170 - DNA, 1586 bp, Homo sapiens; identical to SEQ ID NO: 38

SEQ ID NO: 171 - DNA, 6098 bp, Homo sapiens; identical to SEQ ID NO: 77

SEQ ID NO: 172 - DNA, 1939 bp, Homo sapiens; identical to SEQ ID NO: 78

SEQ ID NO: 173 - DNA, 3167 bp, Homo sapiens; identical to SEQ ID NO: 84

SEQ ID NO: 174 - DNA, 5112 bp, Homo sapiens; identical to SEQ ID NO: 91

SEQ ID NO: 175 - DNA, 2041 bp, Homo sapiens; identical to SEQ ID NO: 93

SEQ ID NO: 176 - DNA, 2679 bp, Homo sapiens; identical to SEQ ID NO: 66

SEQ ID NO: 177 - DNA, 978 bp, Homo sapiens; identical to SEQ ID NO: 72

SEQ ID NO: 178 - DNA, 1931 bp, Homo sapiens
cttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgaaaaaaaaaaaaaaaaaaaaaaaaaaaaaaaaaaaa

SEQ ID NO: 179 - DNA, 1128 bp, Homo sapiens
atggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatga

SEQ ID NO: 180 - DNA, 634 bp, Homo sapiens
gttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaaaaa

SEQ ID NO: 181 - DNA, 2041 bp, Homo sapiens
ctcgcccacgttatggcgcccgaggagaacgcggggaccgaactcttgctgcagggttttgagcgccgcttcctggcggtgcgcacactgcgctccttcccctggcagagcttagaggcaaagttaagagactcatcatattctgagctgctgcgggatattttgcagaagactgtgaggcatcctgtgtgtgtgaagcacccgccgtcagtcaagtatgcctggtgctttctctcagaactcatcaaaaagtcctcaggaggctcggtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcagaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaattccaaatcaggaatcaaaactgccctctaataagacattagctgtctaggcgtgtgggtgccccctttctgccagcagttctggttctcaagaaaatcatcataaatcagacatgaaaattctggctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatcccagggcttatggtgcagcaggcgcttttttcaagacaggaatgaaagtgttaggaacatggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggtacttccagaactggtttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacctccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtgaataaagctttgttggaacaaagccacacccctt

SEQ ID NO: 182 - DNA, 5176 bp, Homo sapiens
tgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagagtgtgtcactttctaaaaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgtttaaaaaaaaaaaaagccaacatttgttgaaactgcataataaattatcatttgtttttagaaacattcaaagaattattttttgattttttttttttttgggacagagtcacccaggctggagtgcagtggcatgatcttggctcactgcaacctccgcctcctgggttcaagcgattctcctgcctcagcctcctgagtagctgggattacaggcatacgccaccacgcccagctaaattttttttgtatttttagtagaggcagggtttcactgtgttggtcaggctggtcttgaactcctgacctcgtgatccacccccccctcagcctcccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttttgagtttttcagtggaatttgttttaaaacgttttgaagatttcagaggccttcatatttctcttatccactttctgaacccataaagcctttgcagtctccttgagtagtttatatttagtaatttagttgtgtacctttttattttgaagtaatttttgatttgcagaagagttgcagagacggtacagggtttccatgtaccctcaccttcccccaagtc

SEQ ID NO: 183 - DNA, 8365 bp, Homo sapiens
agttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttccctt

SEQ ID NO: 184 - DNA, 11577 bp, Homo sapiens
tagttgcagaactagaccattttattttgaaagattcatgttcttcaatgccttcttgttacaggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaggagccaagataggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgttctagtggccctcttcctgtaaacccagatggtgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaacca

We claim:
1. A method of identifying a candidate therapeutic agent against a cancer initiating cell comprising the step of
  a. exposing a human breast primary epithelial cell transformed derivative (BPLER) cell culture to a test agent, wherein said BPLER cell culture comprises human breast primary epithelial cells (BPE) transformed with at least one genetic element selected from hTERT, SV40 early region and h-RAS$^{V12}$;
  b. measuring expression of at least ten malignancy associated response signature biomarkers wherein the at least 10 biomarkers are selected from the expression signature biomarker set consisting of SEQ ID NOs:1-154 in the BPLER cell culture to obtain a measured expression level,
  c. comparing the measured expression level from step (b) to an expression signature reference from a BPLER cell culture that has not been exposed to the test agent, wherein a decrease of expression of at least 5 of the at least 10 biomarkers in the test culture compared to the expression signature reference indicates that the test agent is a candidate therapeutic agent against a cancer initiating cell.
2. The method of claim 1, wherein the cancer initiating cell is a basal-like breast tumor-initiating cell.

* * * * *

UNITED STATES PATENT AND TRADEMARK OFFICE
CERTIFICATE OF CORRECTION

PATENT NO.        : 9,689,040 B2                                  Page 1 of 1
APPLICATION NO.   : 14/003021
DATED             : June 27, 2017
INVENTOR(S)       : Judy Lieberman et al.

It is certified that error appears in the above-identified patent and that said Letters Patent is hereby corrected as shown below:

In the Specification

At Column 1, Lines 17-20, please delete "This invention was made with Government support under W81XWH-09-1-0670 awarded by the Department of Defense. The Government has certain rights in the invention." and insert the following text:
-- This invention was made with government support under grant number W81XWH-09-1-0670 awarded by the U.S. Department of the Army. The Government has certain rights in the invention. --

Signed and Sealed this
Twenty-fourth Day of July, 2018

Andrei Iancu
*Director of the United States Patent and Trademark Office*